US011479600B2

(12) United States Patent
Walker

(10) Patent No.: US 11,479,600 B2
(45) Date of Patent: Oct. 25, 2022

(54) ANTI-RESPIRATORY SYNCYTIAL VIRUS ANTIBODIES, AND METHODS OF THEIR GENERATION AND USE

(71) Applicant: Adimab, LLC, Lebanon, NH (US)

(72) Inventor: Laura M. Walker, Lebanon, NH (US)

(73) Assignee: Adimab, LLC, Lebanon, NH (US)

( * ) Notice: Subject to any disclaimer, the term of this patent is extended or adjusted under 35 U.S.C. 154(b) by 0 days.

(21) Appl. No.: 16/343,273

(22) PCT Filed: Oct. 20, 2017

(86) PCT No.: PCT/US2017/057708
§ 371 (c)(1),
(2) Date: Apr. 18, 2019

(87) PCT Pub. No.: WO2018/075954
PCT Pub. Date: Apr. 26, 2018

(65) Prior Publication Data

US 2019/0256580 A1 Aug. 22, 2019

Related U.S. Application Data

(60) Provisional application No. 62/411,510, filed on Oct. 21, 2016.

(51) Int. Cl.
*C07K 16/10* (2006.01)
*A61P 31/16* (2006.01)
*A61K 39/42* (2006.01)

(52) U.S. Cl.
CPC .......... *C07K 16/1027* (2013.01); *A61K 39/42* (2013.01); *A61P 31/16* (2018.01); *C07K 2317/33* (2013.01); *C07K 2317/34* (2013.01); *C07K 2317/92* (2013.01)

(58) Field of Classification Search
None
See application file for complete search history.

(56) References Cited

U.S. PATENT DOCUMENTS

| | | | | |
|---|---|---|---|---|
| 5,866,125 | A | 2/1999 | Brams et al. | |
| 10,259,874 | B2 * | 4/2019 | Wang | A61P 31/00 |
| 2002/0141990 | A1 | 10/2002 | Deen et al. | |
| 2016/0024188 | A1 | 1/2016 | van den Brink | |
| 2019/0256580 | A1 | 8/2019 | Walker | |
| 2019/0256581 | A1 | 8/2019 | Walker | |
| 2020/0223906 | A1 | 7/2020 | Walker | |

FOREIGN PATENT DOCUMENTS

| | | |
|---|---|---|
| JP | 2010-534057 | 11/2010 |
| JP | 2011-514139 | 5/2011 |
| JP | 2020-503844 | 2/2020 |
| WO | 2008/106980 | 9/2008 |
| WO | 2009/030237 | 3/2009 |
| WO | WO-2014/121021 A1 | 8/2014 |
| WO | 2015/108967 | 7/2015 |
| WO | 2018/075961 | 4/2018 |
| WO | 2018/075974 | 4/2018 |

OTHER PUBLICATIONS

Casset et al. BBRC 307, 198-205 (Year: 2003).*
Van Mechelen et al. (Antiviral Research vol. 132, pp. 1-5 (Year: 2016).*
McLellan, Jason S et al. "Structure of RSV fusion glycoprotein trimer bound to a prefusion-specific neutralizing antibody." Science (New York, N.Y.) vol. 340,6136 (2013): 1113-7. doi:10.1126/science.1234914.
Casset, F. et al., A peptide mimetic of an anti-CD4 monoclonal antibody by rational design, Biochemical and Biophysical Research Communications, 307:198-205 (2003).
Colman, Peter M., Effects of amino acid sequence changes on antibody-antigen interactions, Research in Immunology, 145:33-36 (1994).
Gilman, Morgan S A et al. "Rapid profiling of RSV antibody repertoires from the memory B cells of naturally infected adult donors." Science immunology vol. 1,6 (2016): eaaj1879. doi:10.1126/sciimmunol.aaj1879.
International Search Report for PCT/US2017/057737 (Anti-Respiratory Syncytial Virus Antibodies, and Methods of Their Generation and Use, filed Oct. 20, 2017), issued by ISA/EP, 10 pages (Aug. 30, 2018).
International Search Report for PCT/US2017/057720 (Anti-Respiratory Syncytial Virus Antibodies, and Methods of Their Generation and Use, filed Oct. 20, 2017), issued by ISA/EPO, 10 pages (Mar. 13, 2018).
Janeway, C. et al., Immunobiology: The Immune System in Health and Disease, 5 pages (2005).
Liang, B. et al., Enhanced Neutralizing Antibody Response Induced by Respiratory Syncytial Virus Prefusion F Protein Expressed by a Vaccine Candidate, Journal of Virology, 89(18):9499-9510 (2015).
Liang, B. et al., Packaging and Prefusion Stabilization Separately and Additively Increase the Quantity and Quality of Respiratory Syncytial Virus (RSV)-Neutralizing Antibodies Induced by an RSV Fusion Protein Expressed by a Parainfluenza Virus Vector, Journal of Virology, 90(21): 10022-10038 (2016).
Magro, M. et al., Neutralizing antibodies against the preactive form of respiratory syncytial virus fusion protein offer unique possibilities for clinical intervention, Proc Natl Acad Sci USA, 109(8):3089-94 (2012).

(Continued)

*Primary Examiner* — Shanon A. Foley
*Assistant Examiner* — Myron G Hill
(74) *Attorney, Agent, or Firm* — Robin L. Teskin; Baker, Donelson, Bearman, Caldwell & Berkowitz PC

(57) ABSTRACT

Anti-RSV antibodies with neutralizing potency against RSV subtype A and RSV subtype B are provided, as well as nucleic acid sequences encoding such antibodies, methods for their identification, isolation, generation, and methods for their preparation and use are provided.

22 Claims, 13 Drawing Sheets

Specification includes a Sequence Listing.

(56) References Cited

OTHER PUBLICATIONS

Mechelen, L. et al., RSV neutralization by palivizumab, but not by monoclonal antibodies targeting other epitopes, is augmented by Fc gamma receptors, Antiviral Research, 132:1-5 (2016).
Paul, William E., Fundamental Immunology, 3rd Edition, pp. 292-295 (1993).
Raghunandan, R. et al., An insect cell derived respiratory syncytial virus (RSV) F nanoparticle vaccine induces antigenic site II antibodies and protects against RSV challenge in cotton rats by active and passive immunization, Vaccine, 32(48):6485-92 (2014).
Rudikoff, S. et al., Single amino acid substitution altering antigen-binding specificity, Proc. Natl. Acad. Sci. USA, 79:1979-1983 (1982).
Sela-Culang, I. et al., The structural basis of antibody-antigen recognition, Frontiers in Immunology, 4: 13 pages (2013).
Stryer, Lubert, Biochemistry, 4th Edition, WH Freeman and Company, New York, 8 pages (1995).
Written Opinion for PCT/US2017/057737 (Anti-Respiratory Syncytial Virus Antibodies, and Methods of Their Generation and Use, filed Oct. 20, 2017), issued by ISA/EP, 14 pages (dated Aug. 30, 2018).
Written Opinion for PCT/US2017/057720 (Anti-Respiratory Syncytial Virus Antibodies, and Methods of Their Generation and Use, filed Oct. 20, 2017), issued by ISA/EPO, 12 pages (dated Mar. 13, 2018).
Huang, Jiachen et al. "Antibody Epitopes of Pneumovirus Fusion Proteins." Frontiers in immunology vol. 10 2778. Nov. 29, 2019, doi:10.3389/fimmu.2019.02778.

Corti, D. et al., Cross-neutralization of four paramyxoviruses by a human monoclonal antibody, Nature, 501(7467):439-443 (2013).

Giersing, B. et al., Meeting report: WHO consultation on Respiratory Syncytial Virus (RSV) vaccine development, Geneva, Apr. 25-26, 2016, Vaccine, 8 pages (2017).

International Search Report for PCT/US17/57708 (Anti-Respiratory Syncytial Virus Antibodies, and Methods of Their Generation and Use, filed Oct. 20, 2017), issued by ISA/EP, 10 pages (dated Aug. 30, 2018).

McLellan, Jason S., Neutralizing epitopes on the respiratory syncytial virus fusion glycoprotein, Current Opinion in Virology, 11:70-75 (2015).

Ngwuta, J. et al., Prefusion F-specific antibodies determine the magnitude of RSV neutralizing activity in human sera, Science Translational Medicine, 7(309):309ra162-309ra162 (2015).

Schuster, J. et al., A Broadly Neutralizing Human Monoclonal Antibody Exhibits In Vivo Efficacy Against Both Human Metapneumovirus and Respiratory Syncytial Virus, Journal of Infectious Diseases, 211(2):216-225 (2014).

Written Opinion for PCT/US17/57708 (Anti-Respiratory Syncytial Virus Antibodies, and Methods of Their Generation and Use, filed Oct. 20, 2017), issued by ISA/EP, 15 pages (dated Aug. 30, 2018).

* cited by examiner

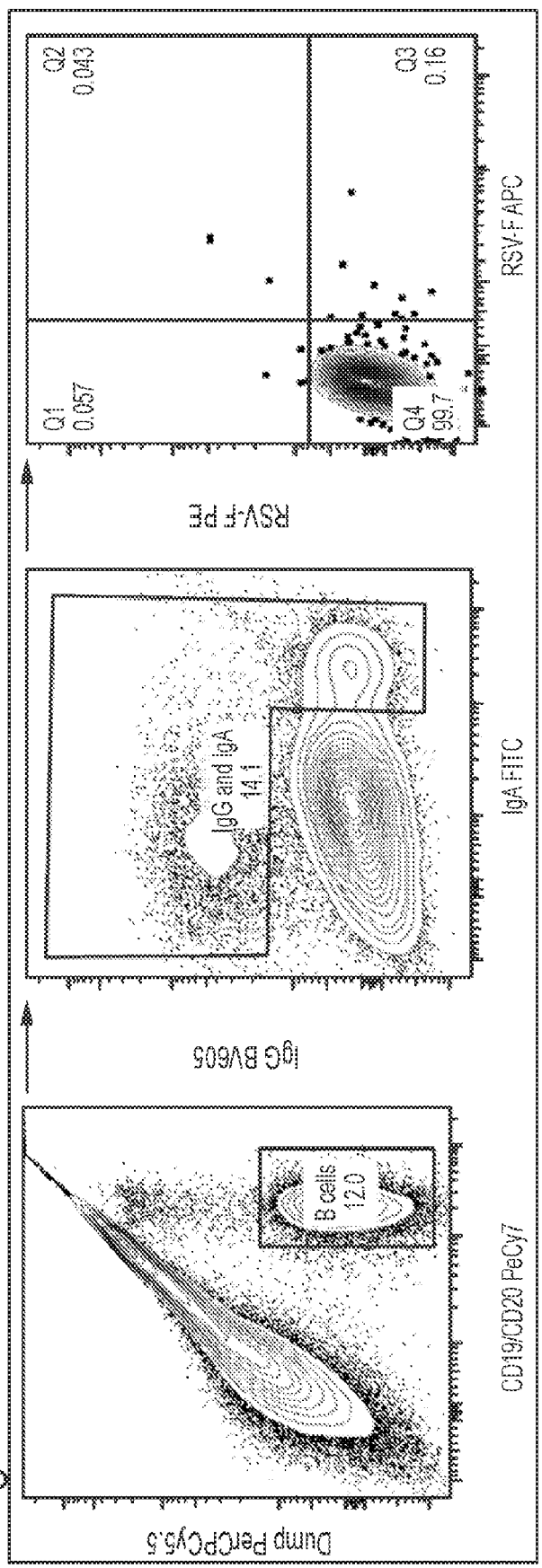
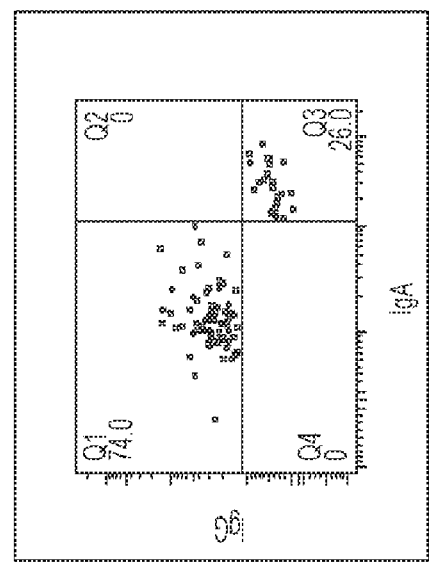
Figure 1A
Figure 1B

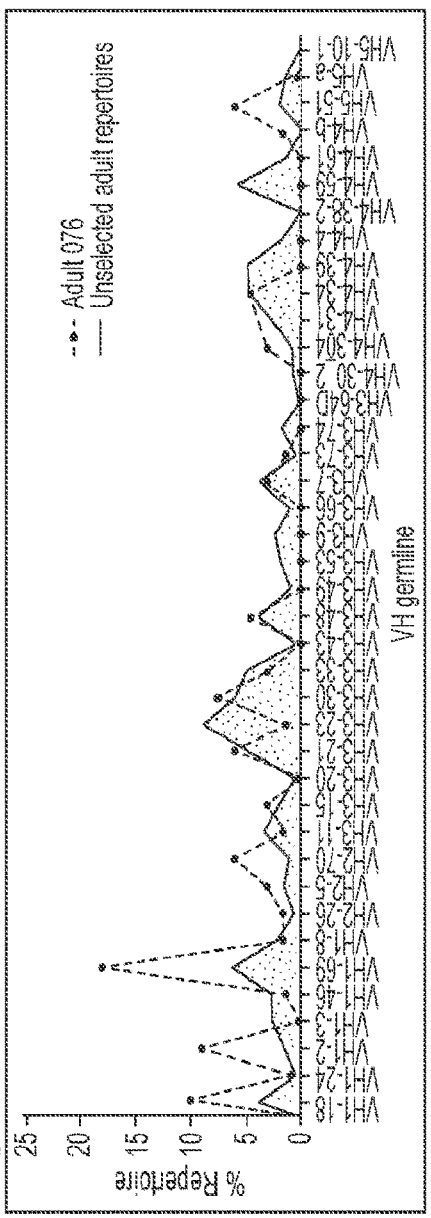
Figure 1C
Figure 1D
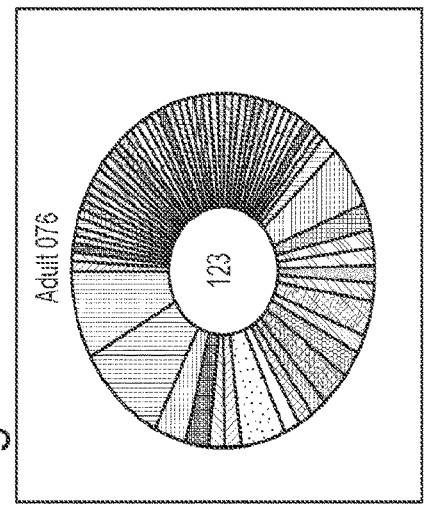
Figure 1E
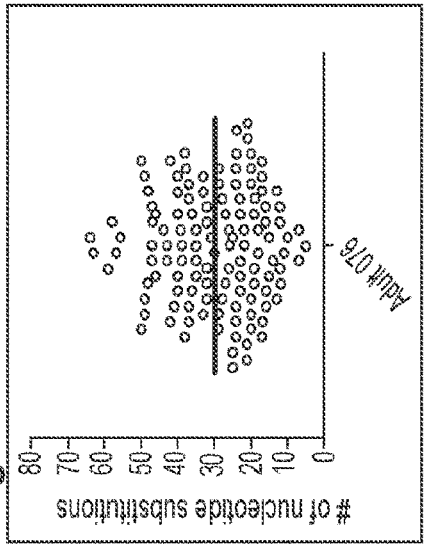
Figure 1F

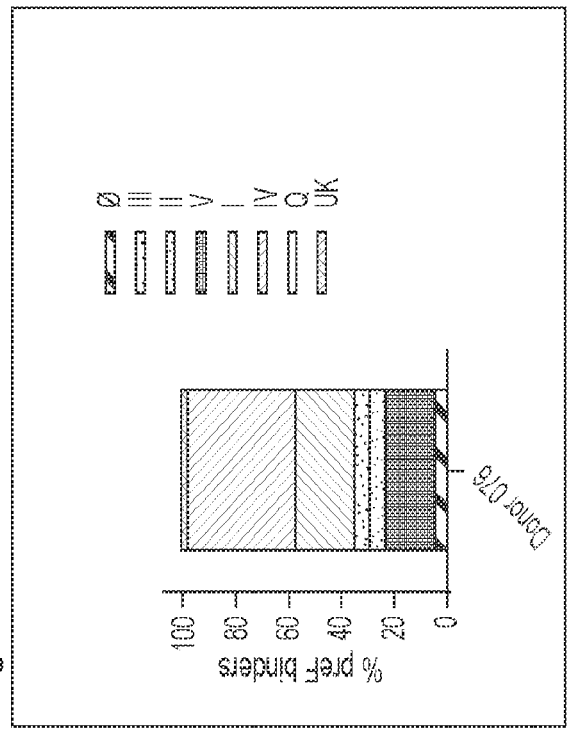
Figure 3B
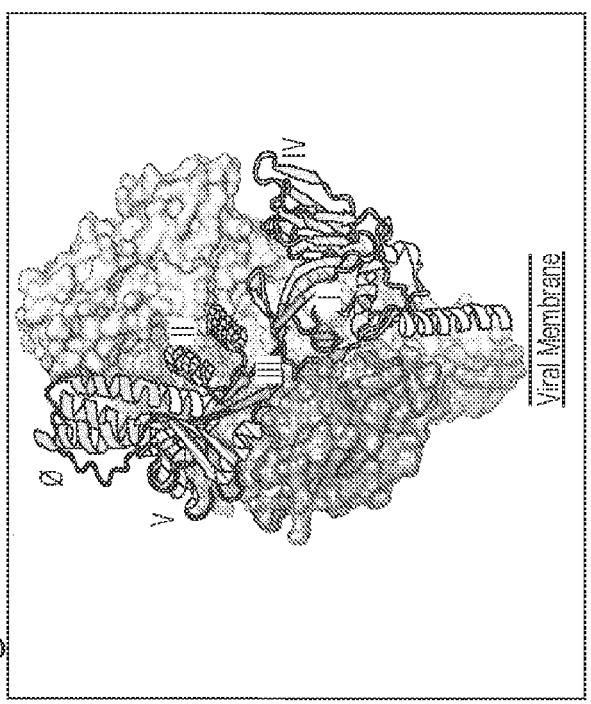
Figure 3A
Figure 3C

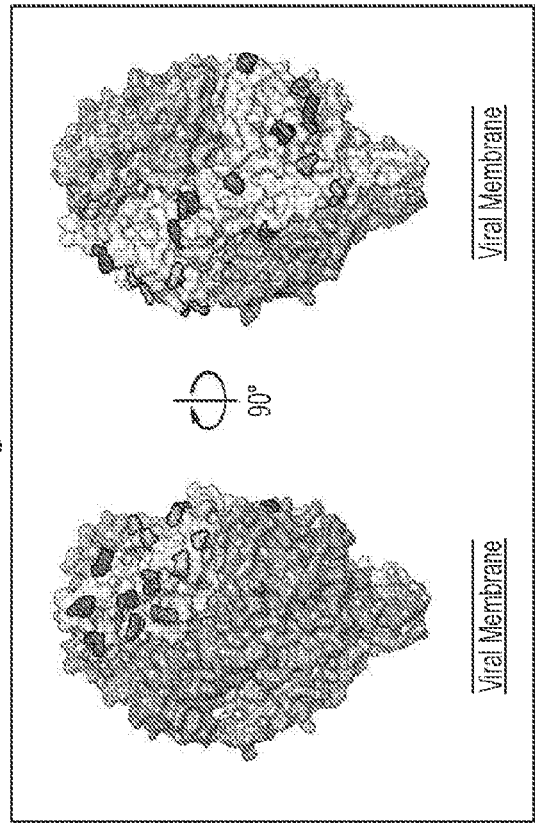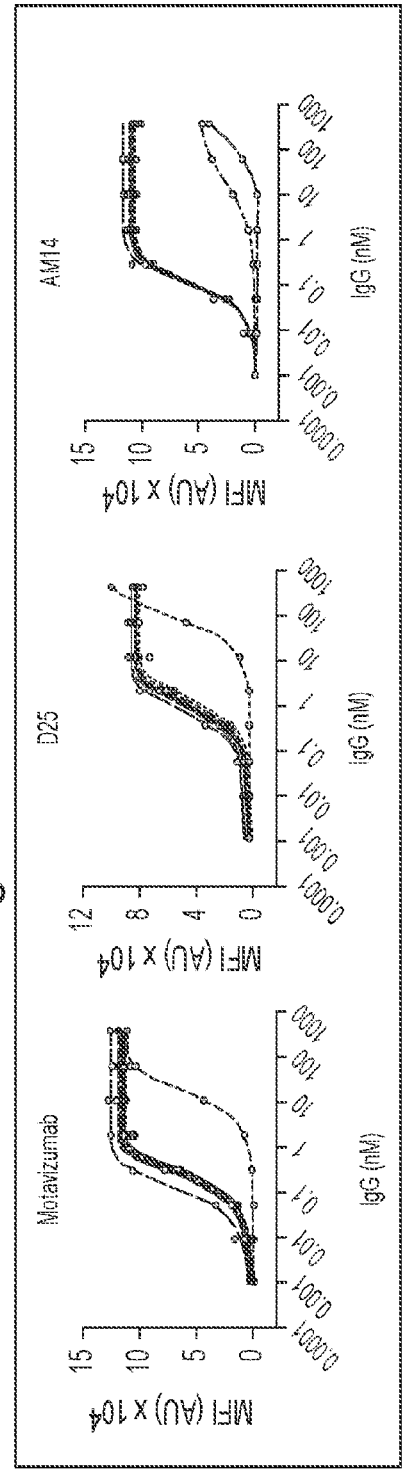

ANTI-RESPIRATORY SYNCYTIAL VIRUS ANTIBODIES, AND METHODS OF THEIR GENERATION AND USE

CROSS REFERENCE TO RELATED APPLICATIONS

This application is a U.S. National Phase application of Int'l Appl. No. PCT/US2017/057708, which was filed Oct. 20, 2017, which claims the benefit of U.S. Provisional Pat. Appl. No. 62/411,510, filed Oct. 21, 2016, the entire contents of which are incorporated herein by reference.

SEQUENCE LISTING

The instant application contains a Sequence Listing which has been submitted electronically in ASCII format and is hereby incorporated by reference in its entirety. Said ASCII copy, created on Nov. 3, 2021, is named "1160430o001401" and is 922,469 bytes in size.

FIELD OF THE INVENTION

The invention relates, inter alia, to anti-Respiratory Syncytial Virus (RSV) antibodies and functional fragments thereof, nucleic acid sequences encoding such antibodies and methods and reagents for their preparation and use.

BACKGROUND OF THE INVENTION

All references cited herein, including without limitation patents, patent applications, and non-patent references and publications referenced throughout are hereby expressly incorporated by reference in their entireties for all purposes.

Respiratory syncytial virus (RSV) causes substantial morbidity and mortality in young children and the elderly, is the leading cause of infant hospitalization in the United States and accounts for an estimated 64 million infections and 160,000 deaths world-wide each year. However, despite decades of research, the development of a safe and effective vaccines or therapeutic and/or prophylactic antibodies against RSV has remained elusive, highlighting the need for novel strategies that induce or provide protective immune responses. (1-3). Indeed, to date there are currently no approved RSV vaccines, and passive prophylaxis with the monoclonal antibody palivizumab (marketed as Synagis®) is restricted to high-risk infants in part due to its modest efficacy.

Certain populations of children are at risk for developing an RSV infection and these include preterm infants (Hall et al., 1979, New Engl. J. Med. 300:393-396), children with congenital malformations of the airway, children with bronchopulmonary dysplasia (Groothuis et al., 1988, Pediatrics 82:199-203), children with congenital heart disease (MacDonald et al., New Engl. J. Med. 307:397-400), and children with congenital or acquired immunodeficiency (Ogra et al., 1988, Pediatr. Infect. Dis. J. 7:246-249; and Pohl et al., 1992, J. Infect. Dis. 165:166-169), and cystic fibrosis (Abman et al., 1988, J. Pediatr. 1 13:826-830).

RSV can infect the adult population as well. In this population, RSV causes primarily an upper respiratory tract disease, although elderly patients may be at greater risk for a serious infection and pneumonia (Evans, A. S., eds., 1989, Viral Infections of Humans. Epidemiology and Control, $3^{rd}$ ed., Plenum Medical Book, New York at pages 525-544), as well as adults who are immunosuppressed, particularly bone marrow transplant patients (Hertz et al., 1989, Medicine 68:269-281). Other at risk patients include those suffering from congestive heart failure and those suffering from chronic obstructive pulmonary disease (i.e. COPD). There have also been reports of epidemics among nursing home patients and institutionalized young adults (Falsey, A. R., 1991, Infect. Control Hosp. Epidemiol. 12:602-608; and Garvie et al., 1980, Br. Med. J. 281: 1253-1254).

While treatment options for established RSV disease are limited, more severe forms of the disease of the lower respiratory tract often require considerable supportive care, including administration of humidified oxygen and respiratory assistance (Fields et al., eds, 1990, Fields Virology, $2^{nd}$ ed., Vol. 1, Raven Press, New York at pages 1045-1072).

Similar to other pneumoviruses, RSV expresses two major surface glycoproteins: the fusion protein (F) and the attachment protein (G). Although both have been shown to induce protective neutralizing antibody responses, F is less genetically variable than G, is absolutely required for infection, and is the target for the majority of neutralizing activity in human serum (4-8). RSV F is also the target of the monoclonal antibody palivizumab, which is used to passively protect high-risk infants from severe disease (9). Consequently, the RSV F protein is considered to be a highly attractive target for vaccines and antibody-based therapies.

The mature RSV F glycoprotein initially exists in a metastable prefusion conformation (preF) (10), before undergoing a conformational change that leads to insertion of the hydrophobic fusion peptide into the host-cell membrane. Subsequent refolding of F into a stable, elongated postfusion conformation (postF) (11, 12) results in fusion of the viral and host-cell membranes. Due to its inherent instability, the preF protein has the propensity to prematurely trigger into postF, both in solution and on the viral surface (13). Recently, stabilization of preF has been achieved by protein engineering (14, 15), and stabilized preF has been shown to induce higher titers of neutralizing antibodies than postF in animal models (15).

Despite the importance of neutralizing antibodies in protection against severe RSV disease, our understanding of the human antibody response to RSV has been limited to studies of human sera and a small number of RSV-specific human monoclonal antibodies (16-19). The epitopes recognized by these human antibodies, as well as several murine antibodies, have defined at least four 'antigenic sites' on RSV F (1, 10, 16, 18-20) (see also, e.g., Table 1). Three of these sites—I, II, and IV—are present on both pre- and postF, whereas antigenic site Ø exists exclusively on preF. Additional preF-specific epitopes have been defined by antibodies MPE8 (17) and AM14 (21). Although serum mapping studies have shown that site Ø-directed antibodies are responsible for a large proportion of the neutralizing antibody response in most individuals (8), there are additional antibody specificities that contribute to serum neutralizing activity that remain to be defined. In addition, it was heretofore unknown whether certain antibody sequence features are required for recognition of certain neutralizing sites, as observed for other viral targets (22-25). Accordingly, understanding the relationship between neutralization potency and epitope specificity would be advantageous in the selection and/or design of vaccine antigens, as well as therapeutic and/or prophylactic antibodies, which induce potent neutralizing responses to RSV.

While treatment options for established RSV disease are limited, more severe forms of the disease of the lower respiratory tract often require considerable supportive care, including administration of humidified oxygen and respiratory assistance (Fields et al., eds, 1990, Fields Virology, 2$^{nd}$ ed., Vol. 1, Raven Press, New York at pages 1045-1072).

Ribavirin, which is the only drug approved for treatment of infection, has been shown to be effective in the treatment of pneumonia and bronchiolitis associated with RSV infection, and has been shown to modify the course of severe RSV disease in immunocompetent children (Smith et al., 1991, New Engl. J. Med. 325:24-29). The use of ribavirin is limited due to concerns surrounding its potential risk to pregnant women who may be exposed to the aerosolized drug while it is being administered in a hospital environment.

Similarly, while a vaccine may be useful, no commercially available vaccine has been developed to date. Several vaccine candidates have been abandoned and others are under development (Murphy et al., 1994, Virus Res. 32: 13-36). The development of a vaccine has proven to be problematic. In particular, immunization would be required in the immediate neonatal period since the peak incidence of lower respiratory tract disease occurs at 2-5 months of age. However, it is known that the neonatal immune response is immature at that time. Plus, the infant at that point in time still has high titers of maternally acquired RSV antibody, which might reduce vaccine immunogenicity (Murphy et al., 1988, J. Virol. 62:3907-3910; and Murphy et al, 1991, Vaccine 9:185-189).

Currently, the only approved approach to prophylaxis of RSV disease is passive immunization. For example, the humanized antibody, palivizumab (SYNAGIS®), which is specific for an epitope on the F protein, is approved for intramuscular administration to pediatric patients for prevention of serious lower respiratory tract disease caused by RSV at recommended monthly doses of 15 mg/kg of body weight throughout the RSV season (November through April in the northern hemisphere). SYNAGIS® is a composite of human (95%) and murine (5%) antibody sequences. (Johnson et al, (1997), J. Infect. Diseases 176: 1215-1224 and U.S. Pat. No. 5,824,307).

Although SYNAGIS® has been successfully used for the prevention of RSV infection in pediatric patients, multiple intramuscular doses of 15 mg/kg of SYNAGIS® are required to achieve a prophylactic effect. The necessity for the administration of multiple intramuscular doses of antibody requires repeated visits to the doctor's office, which is not only inconvenient for the patient but can also result in missed doses.

Efforts were made to improve on the therapeutic profile of an anti-RSV-F antibody, and this lead to the identification and development of motavizumab, also referred to as NUMAX™ However, clinical testing revealed that certain of the patients being administered motavizumab were having severe hypersensitivity reactions. Further development of this humanized anti-RSV-F antibody was then discontinued.

Other antibodies to RSV-F protein have been described and can be found in U.S. Pat. Nos. 6,656,467; 5,824,307; 7,786,273; 7,670,600; 7,083,784; 6,818,216; 7,700,735; 7,553,489; 7,323,172; 7,229,619; 7,425,618; 7,740,851; 7,658,921; 7,704,505; 7,635,568; 6,855,493; 6,565,849; 7,582,297; 7,208,162; 7,700,720; 6,413,771; 5,811,524; 6,537,809; 5,762,905; 7,070,786; 7,364,742; 7,879,329; 7,488,477; 7,867,497; 5,534,411; 6,835,372; 7,482,024; 7,691,603; 8,562,996; 8,568,726; 9,447,173; US20100015596; WO2009088159A1; and WO2014159822. To date, none other than SYNAGIS® has been approved by a regulatory agency for use in preventing an RSV infection.

There remains a need for the provision of highly specific, high affinity, and highly potent neutralizing anti-RSV antibodies and antigen-binding fragments thereof with neutralize at least one, but preferably both, of subtype A and subtype B RSV viral strains, and which preferentially recognize PreF relative to PostF conformations of the F protein. There also remains a need for the provision of anti-RSV and anti-HMPV cross-neutralizing antibodies and antigen-binding fragments thereof.

SUMMARY OF THE INVENTION

Applicant has now discovered, isolated, and characterized, inter alia, an extensive panel of RSV F-specific monoclonal antibodies from the memory B cells of a healthy adult human donor and used these antibodies to comprehensively map the antigenic topology of RSV F. A large proportion of the RSV F-specific human antibody repertoire was advantageously comprised of antibodies with greatly enhanced specificity for the PreF conformation of the F protein (relative to the PostF form), many if not most of which exhibited remarkable potency in neutralization assays against one or both of RSV subtype A and RSV subtype B strains. Indeed, a large number of these antibodies display neutralization potencies that are multiple-fold greater— some 5- to 100-fold greater or more—to previous anti-RSV therapeutic antibodies, such as D25 and pavlizumamab thus serve as attractive therapeutic and/or prophylactic candidates for treating and/or preventing RSV infection and disease.

The most potent antibodies were found to target two distinct antigenic sites that are located near the apex of the preF trimer, providing strong support for the development of therapeutic and/or prophylactic antibodies targeting these antigenic sites, as well as preF-based vaccine candidates that preserve these antigenic sites. Furthermore, the neutralizing antibodies described and disclosed herein represent new opportunities for the prevention of severe RSV disease using passive immunoprophylaxis.

Given the role that the F protein plays in fusion of the virus with the cell and in cell to cell transmission of the virus, the antibodies described herein provide a method of inhibiting that process and as such, may be used for preventing infection of a patient exposed to, or at risk for acquiring an infection with RSV, or for treating and/or ameliorating one or more symptoms associated with RSV infection in a patient exposed to, or at risk for acquiring an infection with RSV, or suffering from infection with RSV. The antibodies and pharmaceutical compositions described herein may also be used to prevent or to treat an RSV infection in a patient who may experience a more severe form of the RSV infection due to an underlying or pre-existing medical condition. A patient who may benefit from treatment with an antibody and/or a pharmaceutical composition of the invention may be a pre-term infant, a full-term infant born during RSV season (approximately late fall (November) through early spring (April)) that is at risk because of other pre-existing or underlying medical conditions including congenital heart disease or chronic lung disease, a child greater than one year of age with or without an underlying medical condition, an institutionalized or hospitalized patient, or an elderly adult (>65 years of age) with or without an underlying medical condition, such as congestive heart failure (CHF), or chronic obstructive pulmonary disease (COPD). A patient who may benefit from such therapy may suffer from a medical condition resulting from a compromised pulmonary, cardiovascular, neuromuscular, or immune system. For example, the patient may suffer from an abnormality of the airway, or an airway malfunction, a chronic lung disease, a chronic or congenital heart disease, a neuromuscular disease that compromises the handling of respiratory secretions, or the patient may be immunosuppressed due to severe combined immunodeficiency disease or severe acquired immunodeficiency disease, or from any other underlying infectious disease or cancerous condition that results in immunosuppression, or the patient may be immunosuppressed due to treatment with an immunosuppressive drug (e.g., any drug used for treating a transplant patient) or radiation therapy. A patient who may benefit from the antibodies and/or pharmaceutical compositions of the invention may be a patient that suffers from chronic obstructive pulmonary disease (COPD), cystic fibrosis (CF), bronchopulmonary dysplasia, congestive heart failure (CHF), or congenital heart disease.

Because the inventive antibodies and antigen-binding fragments thereof are more effective at neutralization of RSV compared to known antibodies, lower doses of the antibodies or antibody fragments or pharmaceutical compositions of the invention could be used to achieve a greater level of protection against infection with RSV, and more effective treatment and/or amelioration of symptoms associated with an RSV infection. Accordingly, the use of lower doses of antibodies, or fragments thereof, which immunospecifically bind to RSV-F antigen and/or pharmaceutical compositions may result in fewer or less severe adverse events. Likewise, the use of more effective neutralizing antibodies may result in a diminished need for frequent administration of the antibodies or antibody fragments or pharmaceutical compositions than previously envisioned as necessary for the prevention of infection, or for virus neutralization, or for treatment or amelioration of one or more symptoms associated with an RSV infection. Symptoms of RSV infection may include a bluish skin color due to lack of oxygen (hypoxia), breathing difficulty (rapid breathing or shortness of breath), cough, croupy cough ("seal bark" cough), fever, nasal flaring, nasal congestion (stuffy nose), apnea, decreased appetite, dehydration, poor feeding, altered mental status, or wheezing.

Such antibodies or pharmaceutical compositions may be useful when administered prophylactically (prior to exposure to the virus and infection with the virus) to lessen the severity, or duration of a primary infection with RSV, or ameliorate at least one symptom associated with the infection. The antibodies or pharmaceutical compositions may be used alone or in conjunction with a second agent useful for treating an RSV infection. In certain embodiments, the antibodies or pharmaceutical compositions may be given therapeutically (after exposure to and infection with the virus) either alone, or in conjunction with a second agent to lessen the severity or duration of the primary infection, or to ameliorate at least one symptom associated with the infection. In certain embodiments, the antibodies or pharmaceutical compositions may be used prophylactically as stand-alone therapy to protect patients who are at risk for acquiring an infection with RSV, such as those described above. Any of these patient populations may benefit from treatment with the antibodies or pharmaceutical compositions of the invention, when given alone or in conjunction with a second agent, including for example, an anti-viral therapy, such as ribavirin, or other anti-viral vaccines.

The antibodies of the invention can be full-length (for example, an IgG1 or IgG4 antibody) or may comprise only an antigen-binding portion (for example, a Fab, F(ab')$_2$ or scFv fragment), and may be modified to affect functionality, e.g., to eliminate residual effector functions (Reddy et al., (2000), J. Immunol. 164:1925-1933).

Accordingly, in certain embodiments are provided isolated antibodies or antigen-binding fragments thereof that specifically bind to Respiratory Syncytial Virus (RSV) F protein (F), wherein at least one, at least two, at least three, at least four, at least five, or at least six of the CDRH1, a CDRH2, a CDRH3, a CDRL1, a CDRL2, and CDRL3 amino acid sequence such antibodies or the antigen-binding fragments thereof are at least 70% identical; at least 75% identical; 80% identical; at least 85% identical; at least 90% identical; at least 95% identical; at least 96% identical; at least 97% identical; at least 98% identical; at least 99%; at least 100% and/or all percentages of identity in between; to at least one, at least two, at least three, at least four, at least five, or at least six of the CDRH1, a CDRH2, a CDRH3, a CDRL1, a CDRL2, and/or a CDRL3 amino acid sequences as disclosed in Table 6 of an antibody selected from Antibody Number 1 through Antibody Number 123 as disclosed in Table 6; and wherein said antibody or the antigen-binding fragment thereof also has one or more of the following characteristics: a) the antibodies or antigen-binding fragments thereof cross-compete with said antibodies or antigen-binding fragments thereof for binding to RSV-F; b) the antibodies or antigen-binding fragments thereof display better binding affinity for the PreF form of RSV-F relative to the PostF form; c) the antibodies or antigen-binding fragments thereof display a clean or low polyreactivity profile; d) the antibodies or antigen-binding fragments thereof display neutralization activity toward RSV subtype A and RSV subtype B in vitro; e) the antibodies or antigen-binding fragments thereof display antigenic site specificity for RSV-F at Site Ø, Site I, Site II, Site III, Site IV, or Site V; f) the antibodies or antigen-binding fragments thereof display antigenic site specificity for RSV-F Site Ø, Site V, or Site III relative to RSV-F Site I, Site II, or Site IV; g) at least a portion of the epitope with which the antibodies or antigen-binding fragments thereof interact comprises the α3 helix and μ3/μ4 hairpin of PreF; h) the antibodies or antigen-binding fragments thereof display an in vitro neutralization potency (IC$_{50}$) of between about 0.5 microgram/milliliter (μg/ml) to about 5 μg/ml; between about 0.05 μg/ml to about 0.5 μg/ml; or less than about 0.05 mg/ml; i) the binding affinities and/or epitopic specificities of the antibodies or antigen-binding fragments thereof for any one of the RSV-F variants designated as 1, 2, 3, 4, 5, 6, 7, 8, 9, and DG in FIG. 7A is reduced or eliminated relative to the binding affinities and/or epitopic specificities of said antibodies or antigen-binding fragments thereof for the RSV-F or RSV-F DS-Cav1; j) the antibodies or antigen-binding fragments thereof display a cross-neutralization potency (IC$_{50}$) against human metapneumovirus (HMPV); k) the antibodies or antigen-binding fragments thereof do not complete with D25, MPE8, palivizumab, or motavizumab; or l) the antibodies or antigen-binding fragments thereof display at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency (IC$_{50}$) than D25 and/or palivizumab.

In certain other embodiments, the isolated antibodies or antigen-binding fragments thereof comprise: at least two; at least three; at least 4; at least 5; at least 6; at least 7; at least 8; at least 9; at least 10; at least 11; or at least 12; of characteristics a) through 1) above.

In certain other embodiments, the isolated antibodies or antigen-binding fragments thereof comprise: a) the CDRH3 amino acid sequence of any one of the antibodies designated Antibody Number 1 through Antibody Number 123 as disclosed in Table 6; b) the CDRH2 amino acid sequence of any one of the antibodies designated Antibody Number 1 through Antibody Number 123 as disclosed in Table 6; c) the CDRH1 amino acid sequence of any one of the antibodies designated Antibody Number 1 through Antibody Number 123 as disclosed in Table 6; d) the CDRL3 amino acid sequence of any one of the antibodies designated Antibody Number 1 through Antibody Number 123 as disclosed in Table 6; e) the CDRL2 amino acid sequence of any one of the antibodies designated Antibody Number 1 through Antibody Number 123 as disclosed in Table 6; f) the CDRL1 amino acid sequence of any one of the antibodies designated Antibody Number 1 through Antibody Number 123 as disclosed in Table 6; or g) any combination of two or more of a), b), c), d), e), and f).

In certain other embodiments, the isolated antibodies or antigen-binding fragments thereof comprise: a) a heavy chain (HC) amino acid sequence of any one of the antibodies designated Antibody Number 1 through Antibody Number 123 as disclosed in Table 6; and/or b) a light chain (LC) amino acid sequence of any one of the antibodies designated Antibody Number 1 through Antibody Number 123 as disclosed in Table 6.

In certain other embodiments, the isolated antibodies or antigen-binding fragments thereof are selected from the group consisting of antibodies that are at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to any one of the antibodies designated as Antibody Number 1 through Antibody Number 123 as disclosed in Table 6.

In certain other embodiments, the isolated antibodies or antigen-binding fragments thereof are selected from the group consisting of the antibodies designated as Antibody Number 1 through Antibody Number 123 as disclosed in Table 6.

In other embodiments are provided isolated nucleic acid sequences encoding antibodies, light and/or heavy chains thereof, antigen-binding fragments thereof, or light and/or heavy chains encoding such antigen-binding fragments according to any of the other embodiments disclosed herein.

In other embodiments are provided expression vectors comprising isolated nucleic acid sequences according to other embodiments disclosed herein.

In other embodiments are provided host cells transfected, transformed, or transduced with nucleic acid sequences or expression vectors according to other embodiments disclosed herein.

In other embodiments are provided pharmaceutical compositions comprising one or more of the isolated antibodies or antigen-binding fragments thereof according to other embodiments disclosed herein; and a pharmaceutically acceptable carrier and/or excipient.

In other embodiments are provided pharmaceutical compositions comprising a nucleic acid sequence of the invention, e.g., one or more nucleic acid sequences encoding at least one of a light or heavy chain of an antibody or both according other embodiments disclosed herein; or one or more the expression vectors according to other embodiments disclosed herein; and a pharmaceutically acceptable carrier and/or excipient.

In other embodiments are provided transgenic organisms comprising nucleic acid sequences according to other embodiments disclosed herein; or expression vectors according to other embodiments disclosed herein.

In other embodiments are provided methods of treating or preventing a Respiratory Syncytial Virus (RSV) infection, or at least one symptom associated with RSV infection, comprising administering to a patient in need there of or suspected of being in need thereof: a) one or more antibodies or antigen-binding fragments thereof according to other embodiments disclosed herein; b) nucleic acid sequences according to other embodiments disclosed herein; an expression vector according to other embodiments disclosed herein; a host cell according to other embodiments disclosed herein; or e) a pharmaceutical composition according to other embodiments disclosed herein; such that the RSV infection is treated or prevented, or the at least on symptom associated with RSV infection is treated, alleviated, or reduced in severity.

In other embodiments are provided methods of treating or preventing either a Respiratory Syncytial Virus (RSV) infection and/or a human metapneumovirus (HEMPV) infection, or at least one symptom associated with said RSV infection or said HMPV infection, comprising administering to a patient in need thereof or suspected of being in need thereof: a) one or more antibodies or antigen-binding fragments thereof according to other embodiments disclosed herein; b) a nucleic acid sequences according to other embodiments disclosed herein; c) an expression vector according to other embodiments disclosed herein; d) a host cell according to other embodiments disclosed herein; or e) a pharmaceutical composition according to other embodiments disclosed herein; such that the RSV infection is treated or prevented, or the at least on symptom associated with RSV infection is treated, alleviated, or reduced in severity. In other embodiments are provided methods according to other embodiments wherein the one or more antibodies or antigen-binding fragments thereof of a) is selected from the group consisting of the antibodies designated as Antibody Number 4, 11, and 62 as disclosed in Table 6.

In other embodiments are provided methods according to other embodiments wherein the method further comprises administering to the patient a second therapeutic agent.

In other embodiments are provided methods according to other embodiments, wherein the second therapeutic agent is selected group consisting of an antiviral agent; a vaccine specific for RSV, a vaccine specific for influenza virus, or a vaccine specific for metapneumovirus (MPV); an siRNA specific for an RSV antigen or a metapneumovirus (MPV) antigen; a second antibody specific for an RSV antigen or a metapneumovirus (MPV) antigen; an anti-IL4R antibody, an antibody specific for an influenza virus antigen, an anti-RSV-G antibody and a NSAID.

In certain embodiments are provided pharmaceutical compositions comprising any one or more of the isolated antibodies or antigen-binding fragments thereof, or one or more nucleic acid sequences encoding at least one of a light chain or heavy chain of an antibody according to other embodiments disclosed herein or an antigen binding fragment thereof, and a pharmaceutically acceptable carrier and/or excipient.

In certain embodiments are provided pharmaceutical compositions according to other embodiments for use in preventing a respiratory syncytial virus (RSV) infection in a patient in need thereof or suspected of being in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration as a result of such use.

In certain embodiments are provided pharmaceutical compositions according to other embodiments for use in treating or preventing either a Respiratory Syncytial Virus (RSV) infection and/or a human metapneumovirus (HMPV) infection, or at least one symptom associated with said RSV infection and/or said HMPV infection, in a patient in need thereof or suspected of being in need thereof, wherein the infection is either prevented, or at least one symptom or complication associated with the infection is prevented, ameliorated, or lessened in severity and/or duration as a result of such use.

In certain other embodiments are provided uses of the pharmaceutical compositions according to other embodiments in the manufacture of a medicament for preventing a respiratory syncytial virus (RSV) infection in a patient in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration.

In certain other embodiments are provided uses of the pharmaceutical compositions according to other embodiments in the manufacture of a medicament for preventing either a Respiratory Syncytial Virus (RSV) infection and/or a human metapneumovirus (HMPV) infection, or at least one symptom associated with said RSV infection and/or said HMPV infection, in a patient in need thereof or suspected of being in need thereof, wherein the infection is either prevented, or at least one symptom or complication associated with the infection is prevented, ameliorated, or lessened in severity and/or duration as a result of such use.

BRIEF DESCRIPTION OF THE FIGURES

FIGS. 1A-1F illustrate the anti-RSV repertoire cloning and sequence analysis of the identified and isolated antibodies. FIG. 1A: RSV F-specific B cell sorting. FACS plots show RSV F reactivity of IgG$^+$ and IgA$^+$ B cells from the healthy adult donor. B cells in quadrant 2 (Q2) were single cell sorted. FIG. 1B: Isotype analysis. Index sort plots show the percentage of RSV F-specific B cells that express IgG or IgA. FIG. 1C: Clonal lineage analysis. Each slice represents one clonal lineage; the size of the slice is proportional to the number of clones in the lineage. The total number of clones is shown in the center of the pie. Clonal lineages were assigned based on the following criteria: 1) matching of variable and joining gene segments; 2) identical CDR3 loop lengths; and 3) >80% homology in CDR3 nucleotide sequences. FIG. 1D: VH repertoire analysis. VH germline genes were considered to be enriched in the RSV repertoire if a given gene was found to be enriched by greater than 3-fold over non-RSV-specific repertoires (33). FIG. 1E: CDRH3 length distribution. FIG. 1F: Somatic hypermutation in VH (excluding CDRH3). Red bar indicates the average number of nucleotide substitutions. Each clonal lineage is only represented once in FIG. 1D and FIG. 1E. Data for non-RSV reactive IgGs were derived from published sequences obtained by high-throughput sequencing of re-arranged antibody variable gene repertoires from healthy individuals (33).

FIG. 2A: IgG affinities for preF and postF are plotted as shown. FIG. 2B: Percentage of antibodies within the donor repertoire that recognized both conformations of F (green) or bind only to preF (blue) or postF (orange). FIG. 2C: Percentage of antibodies within the donor repertoire that bind specifically to subtype A (green), subtype B (blue), or both subtypes A and B (red). N.B., non-binder. IgG $K_{DS}$ were calculated for antibodies with BLI responses >0.1 nm. Antibodies with BLI responses <0.05 nm were designated as N.B. FIG. 2D: Polyreactivity analysis of anti-RSV antibodies. The polyreactivity of the isolated anti-RSV F antibodies was measured using a previously described assay (42, 43). Three panels of control antibodies were included for comparison: a group of 138 antibodies currently in clinical trials, 39 antibodies that have been approved for clinical use and 14 broadly neutralizing HIV antibodies.

FIGS. 3A-3G illustrate mapping and specificities of anti-RSV antibodies for antigenic sites spanning the surface of PreF and PostF. FIG. 3A: The previously determined structure of preF with one protomer shown as ribbons and with six antigenic sites rainbow colored from red to purple. FIG. 3B: The percentage of antibodies targeting each antigenic site is shown. FIG. 3C: Percentage of preF-specific antibodies targeting each antigenic site. FIG. 3D: Apparent antibody binding affinities for subtype A PreF antigenic sites. FIG. 3E: Apparent binding affinities for subtype A postF antigenic sites. FIG. 3F: Apparent antibody binding affinities for subtype B PreF antigenic sites. FIG. 3G. Apparent binding affinities for subtype B postF. Only antibodies with apparent binding affinities greater than 2 nM were included in this analysis, since antibodies with lower affinity could not be reliably mapped. Red bars show the median and the dotted grey line is at 2 nM. N.B., non-binder.

FIG. 4A: Neutralization IC$_{50}$s for the antibodies isolated from the donor repertoire. Data points are colored based on neutralization potency, according to the legend on the right. Red and blue dotted lines depict motavizumab and D25 IC$_{50}$s, respectively. FIG. 4B: Percentage of neutralizing antibodies in the donor repertoire against RSV subtype A or subtype B, stratified by potency as indicated in the legend in the right portion of the figure. FIG. 4C: Percentage of antibodies within the donor repertoire that neutralized both RSV subtypes A and B (red) or neutralized only RSV subtype A (green) or subtype B (blue). FIG. 4D: Apparent binding affinities for subtype A, preF and postF, plotted for each antibody (IgG $K_{DS}$ were calculated for antibodies with BLI responses >0.1 nm. Antibodies with BLI responses <0.05 nm were designated as N.B.) FIG. 4E: Neutralization IC$_{50}$s plotted for RSV subtype A preF-specific, postF-specific, and cross-reactive antibodies. (Red and blue dotted lines depict motavizumab and D25 IC$_{50}$s, respectively. Red bars depict median. N.B., non-binder; N.N., non-neutralizing). FIG. 4F: Apparent antibody binding affinities for subtype B, preF and postF. FIG. 4G: IC$_{50}$s plotted for RSV subtype B preF-specific, postF-specific and cross-reactive antibodies. (Black bar depicts median. N.B., non-binder; N.N., non-neutralizing.)

FIG. 5A: apparent preF $K_D$ plotted against neutralization $IC_{50}$ and colored according to antigenic site, as shown in the legend at right of FIG. 5C. FIG. 5B: apparent postF $K_D$ plotted against neutralization $IC_{50}$ and colored as in FIG. 5A. FIG. 5C: antibodies grouped according to neutralization potency and colored by antigenic site as in legend at right. N.B., non-binder; N.N., non-neutralizing. IgG $K_{DS}$ were calculated for antibodies with BLI responses >0.1 nm. Antibodies with BLI responses <0.05 nm were designated as N.B. Statistical significance was determined using an unpaired two-tailed t test. The Pearson's correlation coefficient, r, was calculated using Prism software version 7.0. Antibodies that failed to bind or neutralize were excluded from the statistical analysis due to the inability to accurately calculate midpoint concentrations.

FIG. 6A: Schematic of fluorescent prefusion RSV F probe shows one PE-conjugated streptavidin molecule bound by four avi-tagged trimeric prefusion F molecules. FIG. 6B: Coomassie-stained SDS-PAGE gel demonstrating the isolation of RSV F with a single AviTag per trimer using sequential Ni-NTA and Strep-Tactin purifications, as described in the Methods. FIG. 6C: Fluorescence size-exclusion chromatography (FSEC) trace of the tetrameric probes on a Superose 6 column. Positions of molecular weight standards are indicated with arrows.

FIGS. 7A-7C illustrate the generation and validation of preF patch panel mutants. FIG. 7A: Panel of RSV F variants used for epitope mapping. FIG. 7B: Prefusion RSV F shown as molecular surface with one protomer colored in white. The nine variants, each containing a patch of mutations, are uniquely colored according to the table in FIG. 7A. FIG. 7C: Binding of each IgG to fluorescently labeled beads coupled to each of the variants listed in FIG. 7A was measured using PE-conjugated anti-human Fc antibody on a FLEXMAP 3D flow cytometer (Luminex). Reduced binding of D25 and motavizumab to patches 1 and 5, respectively, is consistent with their structurally defined epitopes (10, 11). AM14 binding was reduced for both patch 3 and patch 9, due to its unique protomer-spanning epitope (21). This characteristic binding profile was used to assist in the classification of other possible quaternary-specific antibodies in the panel.

FIG. 10A: Subtype B preF affinity plotted against neutralization $IC_{50}$ for all antibodies and colored by antigenic site according to the color scheme depicted in FIG. 10C, right portion. FIG. 10B: PostF affinity plotted against $IC_{50}$ and colored as in FIG. 10A. FIG. 10C: Antibodies with preF affinities higher than 2 nM grouped according to neutralization potency and colored by antigenic site (right portion).

DETAILED DESCRIPTION OF THE INVENTION

Figure 2A:
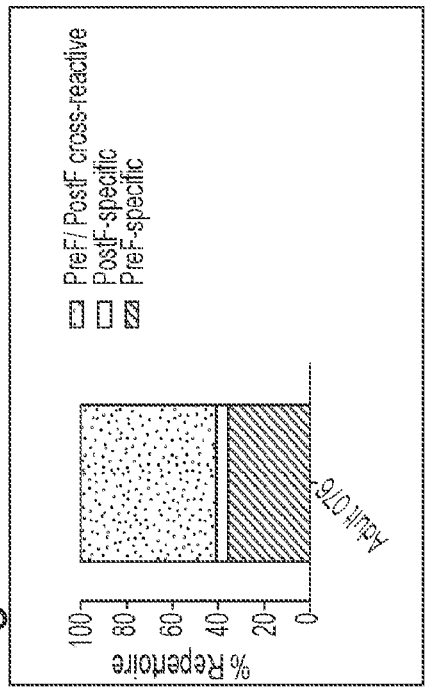
FIGS. 2A-2D illustrate the similar antibody preferences observed for conformational state and subtype of RSV F in the repertoire.

Unless defined otherwise, all technical and scientific terms used herein have the same meaning as commonly understood by one of ordinary skill in the art to which this invention belongs. As used herein, the term "about," when used in reference to a particular recited numerical value, means that the value may vary from the recited value by no more than 1%. For example, as used herein, the expression "about 100" includes 99 and 101 and all values in between (e.g., 99.1, 99.2, 99.3, 99.4, etc.).

Definitions

"Respiratory Syncytial Virus-F protein", also referred to as "RSV-F" or "RSV F" is a type I transmembrane surface protein, which has an N terminal cleaved signal peptide and a membrane anchor near the C terminus (Collins, P. L. et al., (1984), PNAS (USA) 81: 7683-7687). The RSV-F protein is synthesized as an inactive 67 KDa precursor denoted as F0 (Calder, L. J.; et al., Virology (2000), 277, 122-131. The F0 protein is activated proteolytically in the Golgi complex by a furin-like protease at two sites, yielding two disulfide linked polypeptides, F2 and F1, from the N and C terminal, respectively. There is a 27 amino acid peptide released called "pep27". There are furin cleavage sites (FCS) on either side of the pep27 (Collins, P. L.; Mottet, G. (1991), J. Gen. Virol., 72: 3095-3101; Sugrue, R. J, et al. (2001), J. Gen. Virol., 82, 1375-1386). The F2 subunit consists of the Heptad repeat C (HRC), while the F1 contains the fusion polypeptide (FP), heptad repeat A (HRA), domain I, domain II, heptad repeat B (HRB), transmembrane (TM) and cytoplasmic domain (CP) (See Sun, Z. et al. Viruses (2013), 5:21 1-225). The RSV-F protein plays a role in fusion of the virus particle to the cell membrane, and is expressed on the surface of infected cells, thus playing a role in cell to cell transmission of the virus and syncytia formation. The amino acid sequence of the RSV-F protein is provided in GenBank as accession number AAX23994.

A stabilized variant of the PreF trimeric conformation of RSV-F, termed "RSV-DS-Cav1", or "DS-Cav1" disclosed in, inter alia, Stewart-Jones et al., PLos One, Vol. 10(6)): e0128779 and WO 2011/050168. was used in the identification, isolation, and characterization of the antibodies disclosed herein.

The term "laboratory strain" as used herein refers to a strain of RSV (subtype A or B) that has been passaged extensively in in vitro cell culture. A "laboratory strain" can acquire adaptive mutations that may affect their biological properties. A "clinical strain" as used herein refers to an RSV isolate (subtype A or B), which is obtained from an infected individual and which has been isolated and grown in tissue culture at low passage.

The term "effective dose 99" or "$ED_{99}$" refers to the dosage of an agent that produces a desired effect of 99% reduction of viral forming plaques relative to the isotype (negative) control. In the present invention, the $ED_{99}$ refers to the dosage of the anti-RSV-F antibodies that will neutralize the virus infection (e.g., reduce 99% of viral load) in vivo, as described in Example 5.

The term "$IC_{50}$" refers to the "half maximal inhibitory concentration", which value measures the effectiveness of compound (e.g., anti-RSV-F antibody) inhibition towards a biological or biochemical utility. This quantitative measure indicates the quantity required for a particular inhibitor to inhibit a given biological process by half. In certain embodiments, RSV virus neutralization potencies for anti-RSV and/or anti-RSV/anti-HMPV cross-neutralizing antibodies disclosed herein are expressed as neutralization $IC_{50}$ values.

"Palivizumab", also referred to as "SYNAGIS®", is a humanized anti-RSV-F antibody with heavy and light chain variable domains having the amino acid sequences as set forth in U.S. Pat. Nos. 7,635,568 and 5,824,307. This antibody, which immunospecifically binds to the RSV-F protein, is currently FDA-approved for the passive immunoprophylaxis of serious RSV disease in high-risk children and is administered intramuscularly at recommended monthly doses of 15 mg/kg of body weight throughout the RSV season (November through April in the northern hemisphere). SYNAGIS® is composed of 95% human and 5% murine antibody sequences. See also Johnson et al., (1997), J. Infect. Diseases 176:1215-1224.

"Motavizumab", also referred to as "NUMAX™", is an enhanced potency RSV-F-specific humanized monoclonal antibody derived by in vitro affinity maturation of the complementarity-determining regions of the heavy and light chains of palivizumab. For reference purposes, the amino acid sequence of the NUMAX™ antibody is disclosed in U.S. Patent Publication 2003/0091584 and in U.S. Pat. No. 6,818,216 and in Wu et al., (2005) J. Mol. Bio. 350(1):126-144 and in Wu et al. (2007) J. Mol. Biol. 368:652-665. It is also shown herein as SEQ ID NO: 359 for the heavy chain and as SEQ ID NO: 360 for the light chain of the antibody.

As used herein, the terms "treat," "treatment" and "treating" refer to the reduction or amelioration of the progression, severity, and/or duration of an upper and/or lower respiratory tract RSV infection and/or human metapneumovirus (HMPV), otitis media, or a symptom or respiratory condition related thereto (such as asthma, wheezing, or a combination thereof) resulting from the administration of one or more therapies (including, but not limited to, the administration of one or more prophylactic or therapeutic agents). In certain embodiments, such terms refer to the reduction or inhibition of the replication of RSV and/or HMPV, the inhibition or reduction in the spread of RSV and/or HMPV to other tissues or subjects (e.g., the spread to the lower respiratory tract), the inhibition or reduction of infection of a cell with a RSV and/or HMPV, or the amelioration of one or more symptoms associated with an upper and/or lower respiratory tract RSV infection or otitis media.

As used herein, the terms "prevent," "preventing," and "prevention" refer to the prevention or inhibition of the development or onset of an upper and/or lower respiratory tract RSV and/or HMPV infection, otitis media or a respiratory condition related thereto in a subject, the prevention or inhibition of the progression of an upper respiratory tract RSV and/or HMPV infection to a lower respiratory tract RSV and/or HMPV infection, otitis media or a respiratory condition related thereto resulting from the administration of a therapy (e.g., a prophylactic or therapeutic agent), the prevention of a symptom of an upper and/or lower tract RSV and/or HMPV infection, otitis media or a respiratory condition related thereto, or the administration of a combination of therapies (e.g., a combination of prophylactic or therapeutic agents). As used herein, the terms "ameliorate" and "alleviate" refer to a reduction or diminishment in the severity a condition or any symptoms thereof.

The term "antibody", as used herein, is intended to refer to immunoglobulin molecules comprised of four polypeptide chains, two heavy (H) chains and two light (L) chains interconnected by disulfide bonds (i.e., "full antibody molecules"), as well as multimers thereof (e.g. IgM) or antigen-binding fragments thereof. Each heavy chain (HC) is comprised of a heavy chain variable region ("HCVR" or "$V_H$") and a heavy chain constant region (comprised of domains $C_H1$, $C_H2$ and $C_H3$). Each light chain (LC) is comprised of a light chain variable region ("LCVR or "$V_L$") and a light chain constant region ($C_L$). The $V_H$ and $V_L$ regions can be further subdivided into regions of hypervariability, termed complementarity determining regions (CDRs), interspersed with regions that are more conserved, termed framework regions (FRs). Each $V_H$ and $V_L$ is composed of three CDRs and four FRs, arranged from amino-terminus to carboxy-terminus in the following order: FR1, CDR1, FR2, CDR2, FR3, CDR3, FR4. In certain embodiments of the invention, the FRs of the antibody (or antigen-binding fragment thereof) may be identical to the human germline sequences, or may be naturally or artificially modified. An amino acid consensus sequence may be defined based on a side-by-side analysis of two or more CDRs. Accordingly, the CDRs in a heavy chain are designated "CHRH1", "CDRH2", and "CDRH3", respectively, and the CDRs in a light chain are designated "CDRL1", "CDRL2", and "CDRL3".

Substitution of one or more CDR residues or omission of one or more CDRs is also possible. Antibodies have been described in the scientific literature in which one or two CDRs can be dispensed with for binding. Padlan et al. (1995 FASEB J. 9:133-139) analyzed the contact regions between antibodies and their antigens, based on published crystal structures, and concluded that only about one fifth to one third of CDR residues actually contact the antigen. Padlan also found many antibodies in which one or two CDRs had no amino acids in contact with an antigen (see also, Vajdos et al. 2002 J Mol Biol 320:415-428).

CDR residues not contacting antigen can be identified based on previous studies (for example residues H60-H65 in CDRH2 are often not required), from regions of Kabat CDRs lying outside Chothia CDRs, by molecular modeling and/or empirically. If a CDR or residue(s) thereof is omitted, it is usually substituted with an amino acid occupying the corresponding position in another human antibody sequence or a consensus of such sequences. Positions for substitution within CDRs and amino acids to substitute can also be selected empirically.

The fully human monoclonal antibodies disclosed herein may comprise one or more amino acid substitutions, insertions and/or deletions in the framework and/or CDR regions of the heavy and light chain variable domains as compared to the corresponding germline sequences. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding affinity, improved or enhanced antagonistic or agonistic biological properties (as the case may be), reduced immunogenicity, etc. Antibodies and antigen-binding fragments obtained in this general manner are encompassed within the present invention.

The present invention also includes fully monoclonal antibodies comprising variants of any of the CDR amino acid sequences disclosed herein having one or more conservative substitutions. For example, the present invention includes antibodies having CDR amino acid sequences with, e.g., 10 or fewer, 8 or fewer, 6 or fewer, 4 or fewer, etc. conservative amino acid substitutions relative to any of the CDR amino acid sequences disclosed herein.

The term "human antibody", as used herein, is intended to include antibodies having variable and constant regions derived from human germline immunoglobulin sequences. The human mAbs of the invention may include amino acid residues not encoded by human germline immunoglobulin sequences (e.g., mutations introduced by random or site-specific mutagenesis in vitro or by somatic mutation in vivo), for example in the CDRs and in particular CDR3.

However, the term "human antibody", as used herein, is not intended to include mAbs in which CDR sequences derived from the germline of another mammalian species (e.g., mouse), have been grafted onto human FR sequences.

The term "humanized antibody" refers to human antibody in which one or more CDRs of such antibody have been replaced with one or more corresponding CDRs obtained a non-human derived (e.g., mouse, rat, rabbit, primate) antibody. Humanized antibodies may also include certain non-CDR sequences or residues derived from such non-human antibodies as well as the one or more non-human CDR sequence. Such antibodies may also be referred to as "chimeric antibodies".

The term "recombinant" generally refers to any protein, polypeptide, or cell expressing a gene of interest that is produced by genetic engineering methods. The term "recombinant" as used with respect to a protein or polypeptide, means a polypeptide produced by expression of a recombinant polynucleotide. The proteins used in the immunogenic compositions of the invention may be isolated from a natural source or produced by genetic engineering methods.

The antibodies of the invention may, in some embodiments, be recombinant human antibodies. The term "recombinant human antibody", as used herein, is intended to include all antibodies, including human or humanized antibodies, that are prepared, expressed, created or isolated by recombinant means, such as antibodies expressed using a recombinant expression vector transfected into a host cell (described further below), antibodies isolated from a recombinant, combinatorial human antibody library (described further below), antibodies isolated from an animal (e.g., a mouse) that is transgenic for human immunoglobulin genes (see e.g., Taylor et al. (1992) Nucl. Acids Res. 20:6287-6295) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

The term "specifically binds," or "binds specifically to", or the like, means that an antibody or antigen-binding fragment thereof forms a complex with an antigen that is relatively stable under physiologic conditions. Specific binding can be characterized by an equilibrium dissociation constant of at least about $1\times10^{-6}$ M or less (e.g., a smaller $K_D$ denotes a tighter binding). Methods for determining whether two molecules specifically bind are well known in the art and include, for example, equilibrium dialysis, surface plasmon resonance, and the like. As described herein, antibodies have been identified by surface plasmon resonance, e.g., BIACORE™, biolayer interferometry measurements using, e.g., a ForteBio Octet HTX instrument (Pall Life Sciences), which bind specifically to RSV-F. Moreover, multi-specific antibodies that bind to RSV-F protein and one or more additional antigens, such as an antigen expressed by HMPV, or a bi-specific that binds to two different regions of RSV-F are nonetheless considered antibodies that "specifically bind", as used herein. In certain embodiments, the antibodies disclosed herein display equilibrium dissociation constants (and hence specificities) of about $1\times10^{-6}$ M; about $1\times10^{-7}$ M; about $1\times10^{-8}$ M; about $1\times10^{-9}$ M; about $1\times10^{-10}$ M; between about $1\times10^{-6}$ M and about $1\times10^{-7}$ M; between about $1\times10^{-7}$ M and about $1\times10^{-8}$ M; between about $1\times10^{-8}$ M and about $1\times10^{-9}$ M; or between about $1\times10^{-9}$ M and about $1\times10^{-10}$ M.

The term "high affinity" antibody refers to those mAbs having a binding affinity to RSV-F and/or HMPV, expressed as $K_D$, of at least $10^{-9}$ M; more preferably $10^{-10}$ M, more preferably $10^{-11}$ M, more preferably $10^{-12}$ M as measured by surface plasmon resonance, e.g., BIACORE™, biolayer interferometry measurements using, e.g., a ForteBio Octet HTX instrument (Pall Life Sciences), or solution-affinity ELISA.

By the term "slow off rate", "Koff" or "kd" is meant an antibody that dissociates from RSV-F, with a rate constant of $1\times10^{-3}$ s$^{-1}$ or less, preferably $1\times10^{-4}$ s$^{-1}$ or less, as determined by surface plasmon resonance, e.g., BIACORE™ or a ForteBio Octet HTX instrument (Pall Life Sciences).

The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. In certain embodiments, the terms "antigen-binding portion" of an antibody, or "antibody fragment", as used herein, refers to one or more fragments of an antibody that retains the ability to bind to RSV-F and/or HMPV.

An antibody fragment may include a Fab fragment, a F(ab')$_2$ fragment, a Fv fragment, a dAb fragment, a fragment containing a CDR, or an isolated CDR. Antigen-binding fragments of an antibody may be derived, e.g., from full antibody molecules using any suitable standard techniques such as proteolytic digestion or recombinant genetic engineering techniques involving the manipulation and expression of DNA encoding antibody variable and (optionally) constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add or delete amino acids, etc.

Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g. monovalent nanobodies, bivalent nanobodies, etc.), small modular immunopharmaceuticals (SMIPs), and shark variable IgNAR domains, are also encompassed within the expression "antigen-binding fragment," as used herein.

An antigen-binding fragment of an antibody will typically comprise at least one variable domain. The variable domain may be of any size or amino acid composition and will generally comprise at least one CDR, which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H1$; (ii) $V_H$-$C_H2$; (iii) $V_H$-$C_H3$; (iv) $V_H$-$C_h1$-$C_h2$; (v) $V_H$-$C_h1$-$C_h2$-$C_h3$; (vi) $V_H$-$C_H2$-$C_H3$; (vii) $V_H$-$C_L$; (viii) $V_L$-$C_H1$; (ix) $V_L$-$C_H2$; (x) $V_L$-$C_H3$; (xi) $V_L$-$C_H1$-$C_H2$; (xii) $V_L$-$C_H1$-$C_H2$-$C_H3$; (xiii) $V_L$-$C_H2$-$C_H3$; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids, which result in a flexible or semi-flexible linkage between adjacent variable and/or constant domains in a single polypeptide molecule. Moreover, an antigen-binding fragment of an antibody of the present invention may comprise a homo-dimer or heterodimer (or other multimer) of any of the variable and constant domain configurations listed above in non-covalent association with one another and/or with one or more monomeric $V_H$ or $V_L$ domain (e.g., by disulfide bond(s)).

As with full antibody molecules, antigen-binding fragments may be mono-specific or multi-specific (e.g., bi-specific). A multi-specific antigen-binding fragment of an antibody will typically comprise at least two different variable domains, wherein each variable domain is capable of specifically binding to a separate antigen or to a different epitope on the same antigen. Any multi-specific antibody format, including the exemplary bi-specific antibody formats disclosed herein, may be adapted for use in the context of an antigen-binding fragment of an antibody of the present invention using routine techniques available in the art.

The specific embodiments, antibody or antibody fragments of the invention may be conjugated to a therapeutic moiety ("immunoconjugate"), such as an antibiotic, a second anti-RSV-F antibody, an anti-HMPV antibody, a vaccine, or a toxoid, or any other therapeutic moiety useful for treating an RSV infection and/or an HMPV infection.

An "isolated antibody", as used herein, is intended to refer to an antibody that is substantially free of other antibodies (Abs) having different antigenic specificities (e.g., an isolated antibody that specifically binds RSV-F and/or HMPV, or a fragment thereof, is substantially free of Abs that specifically bind antigens other than RSV-F and/or HMPV.

A "blocking antibody" or a "neutralizing antibody", as used herein (or an "antibody that neutralizes RSV-F and/or HMPV activity"), is intended to refer to an antibody whose binding to RSV-F or to an HMPV antigen, as the case may be as disclosed herein, results in inhibition of at least one biological activity of RSV-F and/or HMPV. For example, an antibody of the invention may aid in blocking the fusion of RSV and/or HMPV to a host cell, or prevent syncytia formation, or prevent the primary disease caused by RSV and/or HMPV. Alternatively, an antibody of the invention may demonstrate the ability to ameliorate at least one symptom of the RSV infection and or HMPV infection. This inhibition of the biological activity of RSV-F and/or HMPV can be assessed by measuring one or more indicators of RSV-F and/or HMPV biological activity by one or more of several standard in vitro assays (such as a neutralization assay, as described herein) or in vivo assays known in the art (for example, animal models to look at protection from challenge with RSV and/or HMPV following administration of one or more of the antibodies described herein).

The term "surface plasmon resonance", as used herein, refers to an optical phenomenon that allows for the analysis of real-time biomolecular interactions by detection of alterations in protein concentrations within a biosensor matrix, for example using the BIACORE™ system (Pharmacia Biosensor AB, Uppsala, Sweden and Piscataway, N.J.).

The term "$K_D$", as used herein, is intended to refer to the equilibrium dissociation constant of a particular antibody-antigen interaction.

The term "epitope" refers to an antigenic determinant that interacts with a specific antigen binding site in the variable region of an antibody molecule known as a paratope. A single antigen may have more than one epitope. Thus, different antibodies may bind to different areas on an antigen and may have different biological effects. The term "epitope" also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

The term "substantial identity", or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 90%, and more preferably at least about 95%, 96%, 97%, 98% or 99% of the nucleotide bases, as measured by any well-known algorithm of sequence identity, such as FASTA, BLAST or GAP, as discussed below. Accordingly, nucleic acid sequences that display a certain percentage "identity" share that percentage identity, and/or are that percentage "identical" to one another. A nucleic acid molecule having substantial identity to a reference nucleic acid molecule may, in certain instances, encode a polypeptide having the same or substantially similar amino acid sequence as the polypeptide encoded by the reference nucleic acid molecule.

In certain embodiments, the disclosed antibody nucleic acid sequences are, e.g., at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to other sequences and/or share such percentage identities with one another (or with certain subsets of the herein-disclosed antibody sequences).

In other embodiments, the disclosed antibody nucleic acid sequences are, e.g., at least 70% identical; at least 75% identical; 80% identical; at least 85% identical; at least 90% identical; at least 95% identical; at least 96% identical; at least 97% identical; at least 98% identical; at least 99% identical; or 100% identical; and/or all percentages of identity in between; to other sequences and/or share such percentage identities with one another (or with certain subsets of the herein-disclosed antibody sequences).

As applied to polypeptides, the term "substantial identity" or "substantially identical" means that two peptide sequences, when optimally aligned, such as by the programs GAP or BESTFIT using default gap weights, share at least 90% sequence identity, even more preferably at least 95%, 98% or 99% sequence identity. Accordingly, amino acid sequences that display a certain percentage "identity" share that percentage identity, and/or are that percentage "identical" to one another. Accordingly, amino acid sequences that display a certain percentage "identity" share that percentage identity, and/or are that percentage "identical" to one another.

In certain embodiments, the disclosed antibody amino acid sequences are, e.g., at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to other sequences and/or share such percentage identities with one another (or with certain subsets of the herein-disclosed antibody sequences).

In other embodiments, the disclosed antibody amino acid sequences are, e.g., at least 70% identical; at least 75% identical; 80% identical; at least 85% identical; at least 90% identical; at least 95% identical; at least 96% identical; at least 97% identical; at least 98% identical; at least 99% identical; or 100% identical; and/or all percentages of identity in between; to other sequences and/or share such percentage identities with one another (or with certain subsets of the herein-disclosed antibody sequences).

Preferably, residue positions, which are not identical, differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent or degree of similarity may be adjusted upwards to correct for the conservative nature of the substitution. Means for making this adjustment are well known to those of skill in the art. (See, e.g., Pearson (1994) Methods Mol. Biol. 24: 307-331). Examples of groups of amino acids that have side chains with similar chemical properties include 1) aliphatic side chains: glycine, alanine, valine, leucine and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45. A "moderately conservative" replacement is any change having a nonnegative value in the PAM250 log-likelihood matrix.

Sequence similarity for polypeptides is typically measured using sequence analysis software. Protein analysis software matches similar sequences using measures of similarity assigned to various substitutions, deletions and other modifications, including conservative amino acid substitutions. For instance, GCG software contains programs such as GAP and BESTFIT which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA with default or recommended parameters; a program in GCG Version 6.1. FASTA {e.g., FASTA2 and FASTA3) provides alignments and percent sequence identity of the regions of the best overlap between the query and search sequences (Pearson (2000) supra).

Another preferred algorithm when comparing a sequence of the invention to a database containing a large number of sequences from different organisms is the computer program BLAST, especially BLASTP or TBLASTN, using default parameters. (See, e.g., Altschul et al. (1990) J. Mol. Biol. 215: 403 410 and (1997) Nucleic Acids Res. 25:3389 402).

In certain embodiments, the antibody or antibody fragment for use in the method of the invention may be monospecific, bi-specific, or multi-specific. Multi-specific antibodies may be specific for different epitopes of one target polypeptide or may contain antigen-binding domains specific for epitopes of more than one target polypeptide. An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise an Y96F modification (by IMGT; Y436F by EU). Further modifications that may be found within the second $C_H3$ include: D16E, L18M, N44S, K52N, V57M, and V82I (by IMGT; D356E, L358M, N384S, K392N, V397M, and V422I by EU) in the case of IgG1 mAbs; N44S, K52N, and V82I (IMGT; N384S, K392N, and V422I by EU) in the case of IgG2 mAbs; and Q15R, N44S, K52N, V57M, R69K, E79Q, and V82I (by IMGT; Q355R, N384S, K392N, V397M, R409K, E419Q, and V422I by EU) in the case of IgG4 mAbs. Variations on the bi-specific antibody format described above are contemplated within the scope of the present invention.

By the phrase "therapeutically effective amount" is meant an amount that produces the desired effect for which it is administered. The exact amount will depend on the purpose of the treatment, and will be ascertainable by one skilled in the art using known techniques (see, for example, Lloyd (1999) The Art, Science and Technology of Pharmaceutical Compounding).

An "immunogenic composition" relates to a composition containing an antigen/immunogen, e.g., a microorganism, such as a virus or a bacterium, or a component thereof, a protein, a polypeptide, a fragment of a protein or polypeptide, a whole cell inactivated, subunit or attenuated virus, or a polysaccharide, or combination thereof, administered to stimulate the recipient's humoral and/or cellular immune systems to one or more of the antigens/immunogens present in the immunogenic composition. The immunogenic compositions of the present invention can be used to treat a human susceptible to RSV and/or HMPV infection or suspected of having or being susceptible to RSV and/or HMPV infection, by means of administering the immunogenic compositions via a systemic route. These administrations can include injection via the intramuscular (i.m.), intradermal (i.d.), intranasal or inhalation route, or subcutaneous (s.c.) routes; application by a patch or other transdermal delivery device. In one embodiment, the immunogenic composition may be used in the manufacture of a vaccine or in the elicitation of polyclonal or monoclonal antibodies that could be used to passively protect or treat a mammal.

The terms "vaccine" or "vaccine composition", which are used interchangeably, refer to a composition comprising at least one immunogenic composition that induces an immune response in an animal.

In certain embodiments, a protein of interest comprises an antigen. The terms "antigen," "immunogen," "antigenic," "immunogenic," "antigenically active," and "immunologically active" when made in reference to a molecule, refer to any substance that is capable of inducing a specific humoral and/or cell-mediated immune response. In one embodiment, the antigen comprises an epitope, as defined above.

"Immunologically protective amount", as used herein, is an amount of an antigen effective to induce an immunogenic response in the recipient that is adequate to prevent or ameliorate signs or symptoms of disease, including adverse health effects or complications thereof. Either humoral immunity or cell-mediated immunity or both can be induced. The immunogenic response of an animal to a composition can be evaluated, e.g., indirectly through measurement of antibody titers, lymphocyte proliferation assays, or directly through monitoring signs and symptoms after challenge with the microorganism. The protective immunity conferred by an immunogenic composition or vaccine can be evaluated by measuring, e.g., reduction of shed of challenge organisms, reduction in clinical signs such as mortality, morbidity, temperature, and overall physical condition, health and performance of the subject. The immune response can comprise, without limitation, induction of cellular and/or humoral immunity. The amount of a composition or vaccine that is therapeutically effective can vary, depending on the particular organism used, or the condition of the animal being treated or vaccinated.

An "immune response", or "immunological response" as used herein, in a subject refers to the development of a humoral immune response, a cellular-immune response, or a humoral and a cellular immune response to an antigen/immunogen. A "humoral immune response" refers to one that is at least in part mediated by antibodies. A "cellular immune response" is one mediated by T-lymphocytes or other white blood cells or both, and includes the production of cytokines, chemokines and similar molecules produced by activated T-cells, white blood cells, or both. Immune responses can be determined using standard immunoassays and neutralization assays, which are known in the art.

"Immunogenicity", as used herein, refers to the capability of a protein or polypeptide to elicit an immune response directed specifically against a bacteria or virus that causes the identified disease.

Unless specifically indicated otherwise, the term "antibody," as used herein, shall be understood to encompass antibody molecules comprising two immunoglobulin heavy chains and two immunoglobulin light chains (i.e., "full antibody molecules") as well as antigen-binding fragments thereof. The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex.

Preparation of Human Antibodies

As disclosed herein, anti-RSV and or anti-RSV/anti-HMPF cross neutralizing antibodies by be obtained through B cell sorting techniques available to the artisan, and, for example, as described in the EXAMPLES below. Methods for generating human antibodies in transgenic mice are also known in the art and may be employed in order to derive antibodies in accordance with the present disclosure. Any such known methods can be used in the context of the present invention to make human antibodies that specifically bind to RSV-F (see, for example, U.S. Pat. No. 6,596,541).

In certain embodiments, the antibodies of the instant invention possess affinities ($K_D$) ranging from about $1.0 \times 10^{-7}$ M to about $1.0 \times 10^{-12}$ M, when measured by binding to antigen either immobilized on solid phase or in solution phase. In certain embodiments, the antibodies of the invention possess affinities ($K_D$) ranging from about $1 \times 10^{-7}$ M to about $6 \times 10^{-10}$ M, when measured by binding to antigen either immobilized on solid phase or in solution phase. In certain embodiments, the antibodies of the invention possess affinities ($K_D$) ranging from about $1 \times 10^{-7}$ M to about $9 \times 10^{-10}$ M, when measured by binding to antigen either immobilized on solid phase or in solution phase.

The anti-RSV-F and/or anti-HMPV antibodies and antibody fragments disclosed herein encompass proteins having amino acid sequences that vary from those of the described antibodies, but that retain the ability to bind RSV-F. Such variant antibodies and antibody fragments comprise one or more additions, deletions, or substitutions of amino acids when compared to parent sequence, but exhibit biological activity that is essentially equivalent to that of the described antibodies. Likewise, the antibody-encoding DNA sequences of the present invention encompass sequences that comprise one or more additions, deletions, or substitutions of nucleotides when compared to the disclosed sequence, but that encode an antibody or antibody fragment that is essentially bioequivalent to an antibody or antibody fragment of the invention.

Two antigen-binding proteins, or antibodies, are considered bioequivalent if, for example, they are pharmaceutical equivalents or pharmaceutical alternatives whose rate and extent of absorption do not show a significant difference when administered at the same molar dose under similar experimental conditions, either single does or multiple dose. Some antibodies will be considered equivalents or pharmaceutical alternatives if they are equivalent in the extent of their absorption but not in their rate of absorption and yet may be considered bioequivalent because such differences in the rate of absorption are intentional and are reflected in the labeling, are not essential to the attainment of effective body drug concentrations on, e.g., chronic use, and are considered medically insignificant for the particular drug product studied.

In one embodiment, two antigen-binding proteins are bioequivalent if there are no clinically meaningful differences in their safety, purity, and potency.

In one embodiment, two antigen-binding proteins are bioequivalent if a patient can be switched one or more times between the reference product and the biological product without an expected increase in the risk of adverse effects, including a clinically significant change in immunogenicity, or diminished effectiveness, as compared to continued therapy without such switching.

In one embodiment, two antigen-binding proteins are bioequivalent if they both act by a common mechanism or mechanisms of action for the condition or conditions of use, to the extent that such mechanisms are known.

Bioequivalence may be demonstrated by in vivo and/or in vitro methods. Bioequivalence measures include, e.g., (a) an in vivo test in humans or other mammals, in which the concentration of the antibody or its metabolites is measured in blood, plasma, serum, or other biological fluid as a function of time; (b) an in vitro test that has been correlated with and is reasonably predictive of human in vivo bioavailability data; (c) an in vivo test in humans or other mammals in which the appropriate acute pharmacological effect of the antibody (or its target) is measured as a function of time; and (d) in a well-controlled clinical trial that establishes safety, efficacy, or bioavailability or bioequivalence of an antibody.

Bioequivalent variants of the antibodies of the invention may be constructed by, for example, making various substitutions of residues or sequences or deleting terminal or internal residues or sequences not needed for biological activity. For example, cysteine residues not essential for biological activity can be deleted or replaced with other amino acids to prevent formation of unnecessary or incorrect intramolecular disulfide bridges upon renaturation. In other contexts, bioequivalent antibodies may include antibody variants comprising amino acid changes, which modify the glycosylation characteristics of the antibodies, e.g., mutations that eliminate or remove glycosylation.

Biological and Biophysical Characteristics of the Antibodies

In certain embodiments, the inventive antibodies and antigen-binding fragments thereof specifically bind to Respiratory Syncytial Virus (RSV) F protein (F), wherein at least one of the CDRH1, CDRH2, CDRH3, CDRL1, CDRL2, and/or CDRL3 amino acid sequences of such antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99% identical; or 100% identical, and/or all percentages of identity in between; to at least one of the CDRH1, a CDRH2, a CDRH3, a CDRL1, a CDRL2, and/or a CDRL3 amino acid sequences as disclosed in Table 6 of an antibody selected from Antibody Number 1 through Antibody Number 123 as disclosed in Table 6. In certain embodiments, such antibodies also possess at least one, two, three, four, five, six, seven, eight, nine, ten, or more characteristics disclosed in the immediately following eleven paragraphs.

Without wishing to be bound by any theory, it is believed that the inventive antibodies and antigen-binding fragments thereof may function by binding to RSV-F, preferably in the PreF conformation, and in so doing act to block the fusion of the viral membrane with the host cell membrane. The antibodies of the present invention may also function by binding to RSV-F and in so doing block the cell to cell spread of the virus and block syncytia formation associated with RSV infection of cells. Advantageously, both RSV subtype A and RSV subtype B are effectively blocked, or neutralized, by the majority of the anti-RSV antibodies disclosed herein.

In certain embodiments, the inventive antibodies and antigen-binding fragment thereof display better binding affinity for the PreF form of RSV-F relative to the PostF form of RSV-F.

In certain other embodiments, the inventive antibodies and antigen-binding fragments thereof advantageously display a clean or low polyreactivity profile (see, e.g., WO 2014/179363 and Xu et al., *Protein Eng Des Sel*, October; 26(10):663-70), and are thus particularly amenable to development as safe, efficacious, and developable therapeutic and/or prophylactic anti-RSV and/or HIMPV treatments.

In certain embodiments, the inventive antibodies and antigen-binding fragments thereof, without wishing to be bound by any theory, may function by blocking or inhibiting RSV fusion to the cell membrane by binding to any one or more of, e.g., antigenic Sites Ø, I, II, III, IV, or Site V of the PreF conformation of the F protein. In certain embodiments, the inventive antibodies display antigenic site specificity for Site Ø, Site V, or Site III of PreF relative to RSV-F Site I, Site II, or Site IV.

In certain embodiments, at least a portion of the epitope with which the inventive antibodies and antigen-binding fragments thereof interacts comprises a portion of the α3 helix and β3/β4 hairpin of PreF. In certain embodiments, substantially all of the epitope of such antibodies comprises the α3 helix and β3/β4 hairpin of PreF. In still further embodiments, the inventive antibodies cross-compete with antibodies that recognize a portion or substantially all of the α3 helix and µ3/µ4 hairpin of PreF.

In certain embodiments, the inventive antibodies and antigen-binding fragments thereof display an in vitro neutralization potency ($IC_{50}$) of between about 0.5 microgram/milliliter (µg/ml) to about 5 µg/ml; between about 0.05 µg/ml to about 0.5 µg/ml; or less than about 0.05 mg/ml.

In certain embodiments, the binding affinity and/or epitopic specificity of the inventive antibodies and antigen-binding fragments thereof for any one of the RSV-F variants designated as 1, 2, 3, 4, 5, 6, 7, 8, 9, and DG in FIG. 7A is reduced or eliminated relative to the binding affinity and/or epitopic specificity of said antibody or antigen-binding fragment thereof for the RSV-F or RSV-F DS-Cav1.

In certain embodiments, the inventive antibodies and antigen-binding fragments thereof display a cross-neutralization potency ($IC_{50}$) against human metapneumovirus (HMPV) as well as RSV. In certain such embodiments, the inventive antibodies and antigen-binding fragments thereof comprise at least one of the CDRH1, CDRH2, CDRH3, CDRL1, CDRL2, and/or CDRL3 amino acid sequences of such antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99% identical; or 100% identical; and/or all percentages of identity in between; to at least one of the CDRH1, a CDRH2, a CDRH3, a CDRL1, a CDRL2, and/or a CDRL3 amino acid sequences as disclosed in Table 6 of an antibody selected from the group consisting of Antibody Number 4, 11, and 62 as disclosed in Table 6.

In certain embodiments, the inventive antibodies and antigen-binding fragments thereof do not complete with D25, MPE8, palivisumab, motavizumab, or AM-14. In certain embodiments, the inventive antibodies and antigen-binding fragments thereof do not complete with D25, MPE8, palivisumab, or motavizumab. In certain embodiments, the inventive antibodies and antigen-binding fragments thereof do not complete with MPE8, palivisumab, or motavizumab. In certain embodiments, the inventive antibodies and antigen-binding fragments thereof do not complete with D25, palivisumab, or motavizumab. In certain embodiments, the inventive antibodies and antigen-binding fragments thereof do not complete with D25. In certain embodiments, the inventive antibodies and antigen-binding fragments thereof do not complete with MPE8. In certain embodiments, the inventive antibodies and antigen-binding fragments thereof do not complete with palivisumab. In certain embodiments, the inventive antibodies and antigen-binding fragments thereof do not complete with motavizumab.

In certain embodiments, the inventive antibodies and antigen-binding fragments thereof complete with one or more of D25, MPE8, palivisumab, motavizumab, and/or AM-14.

In certain embodiments, the inventive antibodies and antigen-binding fragments thereof display at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency ($IC_{50}$) than D25 and/or palivizumab.

In certain embodiments, the inventive antibodies and antigen-binding fragments thereof comprise the CDRH3 amino acid sequence of any one of the antibodies designated Antibody Number 1 through Antibody Number 123 as disclosed in Table 6.

In certain embodiments, the inventive antibodies and antigen-binding fragments thereof comprise the CDRH2 amino acid sequence of any one of the antibodies designated Antibody Number 1 through Antibody Number 123 as disclosed in Table 6.

In certain embodiments, the inventive antibodies and antigen-binding fragments thereof comprise the CDRH1 amino acid sequence of any one of the antibodies designated Antibody Number 1 through Antibody Number 123 as disclosed in Table 6.

In certain embodiments, the inventive antibodies and antigen-binding fragments thereof comprise the CDRL3 amino acid sequence of any one of the antibodies designated Antibody Number 1 through Antibody Number 123 as disclosed in Table 6.

In certain embodiments, the inventive antibodies and antigen-binding fragments thereof comprise the CDRL2 amino acid sequence of any one of the antibodies designated Antibody Number 1 through Antibody Number 123 as disclosed in Table 6.

In certain embodiments, the inventive antibodies and antigen-binding fragments thereof comprise the CDRL1 amino acid sequence of any one of the antibodies designated Antibody Number 1 through Antibody Number 123 as disclosed in Table 6.

In certain embodiments, the inventive antibodies and antigen-binding fragments thereof comprise any combination of two, three, four, five, or six characteristics disclosed in the immediately preceding paragraphs, i.e., a) the anti-RSV F antibody cross-competes with an antibody selected from Antibody Number 1 through Antibody Number 123 as disclosed in Table 6 for binding to RSV-F; b) the anti-RSV F antibody displays better binding affinity for the PreF form of RSV-F relative to the PostF form of RSV-F; c) the anti-RSV F antibody displays a clean or low polyreactivity profile; d) the anti-RSV F antibody displays neutralization activity toward RSV subtype A and RSV subtype B in vitro; e) the anti-RSV F antibody displays antigenic site specificity for RSV-F at Site Ø, Site I, Site II, Site III, Site IV, or Site V; f) the anti-RSV F antibody displays antigenic site specificity for RSV-F Site Ø, Site V, or Site III relative to RSV-F Site I, Site II, or Site IV; g) at least a portion of the epitope with which the anti-RSV F antibody interacts comprises the α3 helix and β3/β4 hairpin of PreF; h) the anti-RSV F antibody displays an in vitro neutralization potency ($IC_{50}$) of between about 0.5 microgram/milliliter (µg/ml) to about 5 µg/ml; between about 0.05 µg/ml to about 0.5 µg/ml; or less than about 0.05 mg/ml; i) the binding affinity and/or epitopic specificity of the anti-RSV F antibody for any one of the RSV-F variants designated as 1, 2, 3, 4, 5, 6, 7, 8, 9, and DG in FIG. 7A is reduced or eliminated relative to the binding affinity and/or epitopic specificity of anti-RSV F antibody for RSV-F or RSV-F DS-Cav1; j) the anti-RSV F antibody displays a cross-neutralization potency ($IC_{50}$) against human metapneumovirus (HMPV); k) the anti-RSV F antibody does not complete with D25, MPE8, palivisumab, motavizumab, or AM-14; or 1) the anti-RSV F antibody displays at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency ($IC_{50}$) than D25 and/or palivizumab.

In certain embodiments, the inventive antibodies and antigen-binding fragments thereof comprise a heavy chain (HC) amino acid sequence of any one of the antibodies designated Antibody Number 1 through Antibody Number 123 as disclosed in Table 6. In certain embodiments, the inventive antibodies and antigen-binding fragments thereof comprise a light chain (LC) amino acid sequence of any one of the antibodies designated Antibody Number 1 through Antibody Number 123 as disclosed in Table 6. In certain embodiments, the inventive antibodies and antigen-binding fragments thereof comprise a heavy chain (HC) amino acid sequence and a light chain (LC) amino acid sequence of any one of the antibodies designated Antibody Number 1 through Antibody Number 123 as disclosed in Table 6.

In certain embodiments, the inventive antibodies and antigen-binding fragments thereof are each selected from the group consisting antibodies that are at least 70% identical; at least 75% identical; 80% identical; at least 85% identical; at least 90% identical; at least 95% identical; at least 96% identical; at least 97% identical; at least 98% identical; at least 99% identical; or 100% identical; and/or all percentages of identity in between; to any one of the antibodies designated as Antibody Number 1 through Antibody Number 123 as disclosed in Table 6.

In certain embodiments, the inventive antibodies and antigen-binding fragments thereof comprise are each selected from the group consisting of the antibodies designated as Antibody Number 1 through Antibody Number 123 as disclosed in Table 6.

In certain embodiments, isolated nucleic acid sequences are provided that encode antibodies or antigen binding fragments thereof that specifically bind to Respiratory Syncytial Virus (RSV) F protein and antigen-binding fragments thereof, wherein at least one of the CDRH1, CDRH2, CDRH3, CDRL1, CDRL2, and/or CDRL3 amino acid sequences of the antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99% identical; or at least 100% identical and/or all percentages of identity in between; to at least one the CDRH1, CDRH2, CDRH3, CDRL1, CDRL2, and/or CDRL3 amino acid sequences as disclosed in Table 6 of an antibody selected from Antibody Number 1 through Antibody Number 123 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRH3 amino acid sequence of the antibodies designated Antibody Number 1 through Antibody Number 123 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRH2 amino acid sequences of the antibodies designated Antibody Number 1 through Antibody Number 123 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRH1 amino acid sequences of the antibodies designated Antibody Number 1 through Antibody Number 123 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRL3 amino acid sequences of the antibodies designated Antibody Number 1 through Antibody Number 123 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRL2 amino acid sequences of the antibodies designated Antibody Number 1 through Antibody Number 123 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRL1 amino acid sequences of the antibodies designated Antibody Number 1 through Antibody Number 123 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the CDRL1, CDRL2, CDRL3, CDRH1, CDRH2, and CDRH3 amino acid sequences of the antibodies designated Antibody Number 1 through Antibody Number 123 as disclosed in Table 6, i.e., have identity across six CDRs with one of the antibodies of the invention.

In certain embodiments, isolated nucleic acid sequences are provided that encode the inventive antibodies and antigen-binding fragments thereof, wherein such nucleic acid sequences comprise sequences that encode the heavy chain (HC) amino acid sequences of the antibodies designated Antibody Number 1 through Antibody Number 123 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the HC CDR amino acid sequences of the antibodies designated Antibody Number 1 through Antibody Number 123 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the light chain (LC) amino acid sequences of the antibodies designated Antibody Number 1 through Antibody Number 123 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences that encode the LC CDR amino acid sequences of the antibodies designated Antibody Number 1 through Antibody Number 123 as disclosed in Table 6. In certain embodiments, such nucleic acid sequences are selected from those nucleic acid sequences that are disclosed in Table 6, and compliments thereof.

In certain embodiments, isolated nucleic acid sequences are provided that encode the inventive antibodies and antigen-binding fragments thereof, wherein such nucleic acid sequences comprise sequences are each selected from the group consisting of sequences that are at least 70% identical; at least 75% identical; 80% identical; at least 85% identical; at least 90% identical; at least 95% identical; at least 96% identical; at least 97% identical; at least 98% identical; at least 99% identical; at least 100% identical, and/or all percentages of identity in between; to any one of the nucleic acid sequences that are disclosed in Table 6, and compliments thereof.

In certain embodiments, the nucleic acid sequences of the invention may be modified according to methods known in the art. In other embodiments, the nucleic acid sequences of the invention may be present in or complexed with an art recognized carrier, e.g., a lipid nanoparticle, a polymeric nanomicelle, a linear or branched polymer or a lipid/lipid-like material.

In certain embodiments, expression vectors are provided comprising the isolated nucleic acid sequences disclose herein and throughout, and in particular in the immediately preceding paragraphs.

In certain embodiments, host cells transfected, transformed, or transduced with the nucleic acid sequences and/or the expression vectors disclosed immediately above are provided.

Epitope Mapping and Related Technologies

As described above and as demonstrated in the EXAMPLES, Applicant has characterized the epitopic specificities, bin assignments, and antigenic site assignments of the inventive antibodies and antigen-binding fragments thereof. In addition to the methods for conducting such characterization, various other techniques are available to the artisan that can be used to carry out such characterization or to otherwise ascertain whether an antibody "interacts with one or more amino acids" within a polypeptide or protein. Exemplary techniques include, for example, a routine cross-blocking assay such as that described Antibodies, Harlow and Lane (Cold Spring Harbor Press, Cold Spring Harb., NY) can be performed. Other methods include alanine scanning mutational analysis, peptide blot analysis (Reineke (2004) Methods Mol Biol 248:443-63), peptide cleavage analysis crystallographic studies and NMR analysis. In addition, methods such as epitope excision, epitope extraction and chemical modification of antigens can be employed (Tomer (2000) Protein Science 9: 487-496). Another method that can be used to identify the amino acids within a polypeptide with which an antibody interacts is hydrogen/deuterium exchange detected by mass spectrometry. In general terms, the hydrogen/deuterium exchange method involves deuterium-labeling the protein of interest, followed by binding the antibody to the deuterium-labeled protein. Next, the protein/antibody complex is transferred to water and exchangeable protons within amino acids that are protected by the antibody complex undergo deuterium-to-hydrogen back-exchange at a slower rate than exchangeable protons within amino acids that are not part of the interface. As a result, amino acids that form part of the protein/antibody interface may retain deuterium and therefore exhibit relatively higher mass compared to amino acids not included in the interface. After dissociation of the antibody, the target protein is subjected to protease cleavage and mass spectrometry analysis, thereby revealing the deuterium-labeled residues that correspond to the specific amino acids with which the antibody interacts. See, e.g., Ehring (1999) Analytical Biochemistry 267 (2):252-259; Engen and Smith (2001) Anal. Chem. 73:256A-265A.

As the artisan will understand, an epitope can be formed both from contiguous amino acids or noncontiguous amino acids juxtaposed by tertiary folding of a protein. Epitopes formed from contiguous amino acids are typically retained on exposure to denaturing solvents, whereas epitopes formed by tertiary folding are typically lost on treatment with denaturing solvents. An epitope typically includes at least 3, and more usually, at least 5 or 8-10 amino acids in a unique spatial conformation.

Modification-Assisted Profiling (MAP), also known as Antigen Structure-based Antibody Profiling (ASAP) is a method that categorizes large numbers of monoclonal antibodies (mAbs) directed against the same antigen according to the similarities of the binding profile of each antibody to chemically or enzymatically modified antigen surfaces (U.S. Publ. No. 2004/0101920). Each category may reflect a unique epitope either distinctly different from or partially overlapping with epitope represented by another category. This technology allows rapid filtering of genetically identical antibodies, such that characterization can be focused on genetically distinct antibodies. When applied to hybridoma screening, MAP may facilitate identification of rare hybridoma clones that produce mAbs having the desired characteristics. MAP may be used to sort the antibodies of the invention into groups of antibodies binding different epitopes.

In certain embodiments, the inventive antibodies and/or antigen-binding fragments thereof interact with an amino acid sequence comprising the amino acid residues that are altered in one or more of the F protein patch variants disclosed, e.g., in the EXAMPLES and which are depicted in, e.g., FIG. 7A and which are designated as RSV F Variants 1, 2, 3, 4, 5, 6, 7, 8, 9, and DG. In certain embodiments, such inventive antibodies and antigen-binding fragments thereof interact with an amino acid sequence comprising the amino acid residues that are altered in RSV F Variant 2. In certain embodiments, the inventive antibodies and/or antigen-binding fragments thereof interact with amino acid residues that extend beyond the region(s) identified above by about 5 to 10 amino acid residues, or by about 10 to 15 amino acid residues, or by about 15 to 20 amino acid residues towards either the amino terminal or the carboxy terminal of the RSV-F protein.

In certain embodiments, the antibodies of the present invention do not bind to the same epitope on RSV-F protein as palivizumab, motavizumab, MPE8, or AM-14.

As the artisan understands, one can easily determine whether an antibody binds to the same epitope as, or competes for binding with, a reference anti-RSV-F antibody by using routine methods available in the art. For example, to determine if a test antibody binds to the same epitope as a reference RSV-F antibody of the invention, the reference antibody is allowed to bind to a RSV-F protein or peptide under saturating conditions. Next, the ability of a test antibody to bind to the RSV-F molecule is assessed. If the test antibody is able to bind to RSV-F following saturation binding with the reference anti-RSV-F antibody, it can be concluded that the test antibody binds to a different epitope than the reference anti-RSV-F antibody. On the other hand, if the test antibody is not able to bind to the RSV-F molecule following saturation binding with the reference anti-RSV-F antibody, then the test antibody may bind to the same epitope as the epitope bound by the reference anti-RSV-F antibody of the invention.

To determine if an antibody competes for binding with a reference anti-RSV-F antibody, the above-described binding methodology is performed in two orientations: In a first orientation, the reference antibody is allowed to bind to a RSV-F molecule under saturating conditions followed by assessment of binding of the test antibody to the RSV-F molecule. In a second orientation, the test antibody is allowed to bind to a RSV-F molecule under saturating conditions followed by assessment of binding of the reference antibody to the RSV-F molecule. If, in both orientations, only the first (saturating) antibody is capable of binding to the RSV-F molecule, then it is concluded that the test antibody and the reference antibody compete for binding to RSV-F. As will be appreciated by a person of ordinary skill in the art, an antibody that competes for binding with a reference antibody may not necessarily bind to the identical epitope as the reference antibody, but may sterically block binding of the reference antibody by binding an overlapping or adjacent epitope.

Two antibodies bind to the same or overlapping epitope if each competitively inhibits (blocks) binding of the other to the antigen. That is, a 1-, 5-, 10-, 20- or 100-fold excess of one antibody inhibits binding of the other by at least 50% but preferably 75%, 90% or even 99% as measured in a competitive binding assay (see, e.g., Junghans et al., Cancer Res. (1990) 50:1495-1502). Alternatively, two antibodies have the same epitope if essentially all amino acid mutations in the antigen that reduce or eliminate binding of one antibody reduce or eliminate binding of the other. Two antibodies have overlapping epitopes if some amino acid mutations that reduce or eliminate binding of one antibody reduce or eliminate binding of the other.

Additional routine experimentation (e.g., peptide mutation and binding analyses) can then be carried out to confirm whether the observed lack of binding of the test antibody is in fact due to binding to the same epitope as the reference antibody or if steric blocking (or another phenomenon) is responsible for the lack of observed binding. Experiments of this sort can be performed using ELISA, RIA, surface plasmon resonance, flow cytometry or any other quantitative or qualitative antibody-binding assay available in the art.

Immunoconjugates

The invention encompasses a human RSV-F monoclonal antibody conjugated to a therapeutic moiety ("immunoconjugate"), such as an agent that is capable of reducing the severity of primary infection with RSV and/or HMPV, or to ameliorate at least one symptom associated with RSV infection and/or HMPV infection, including coughing, fever, pneumonia, or the severity thereof. Such an agent may be a second different antibody to RSV-F and/or HMPV, or a vaccine. The type of therapeutic moiety that may be conjugated to the anti-RSV-F antibody and/or anti-HMPV antibody and will take into account the condition to be treated and the desired therapeutic effect to be achieved. Alternatively, if the desired therapeutic effect is to treat the sequelae or symptoms associated with RSV and/or HMPV infection, or any other condition resulting from such infection, such as, but not limited to, pneumonia, it may be advantageous to conjugate an agent appropriate to treat the sequelae or symptoms of the condition, or to alleviate any side effects of the antibodies of the invention. Examples of suitable agents for forming immunoconjugates are known in the art, see for example, WO 05/103081.

Multi-Specific Antibodies

The antibodies of the present invention may be monospecific, bi-specific, or multi-specific. Multi-specific antibodies may be specific for different epitopes of one target polypeptide or may contain antigen-binding domains specific for more than one target polypeptide. See, e.g., Tutt et al., 1991, J. Immunol. 147:60-69; Kufer et al., 2004, Trends Biotechnol. 22:238-244. The antibodies of the present invention can be linked to or co-expressed with another functional molecule, e.g., another peptide or protein. For example, an antibody or fragment thereof can be functionally linked {e.g., by chemical coupling, genetic fusion, noncovalent association or otherwise) to one or more other molecular entities, such as another antibody or antibody fragment to produce a bi-specific or a multi-specific antibody with a second binding specificity.

An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise a Y96F modification (by IMGT; Y436F by EU). Further modifications that may be found within the second $C_H3$ include: D16E, L18M, N44S, K52N, V57M, and V82I (by IMGT; D356E, L358M, N384S, K392N, V397M, and V422I by EU) in the case of IgG1 antibodies; N44S, K52N, and V82I (IMGT; N384S, K392N, and V422I by EU) in the case of IgG2 antibodies; and Q15R, N44S, K52N, V57M, R69K, E79Q, and V82I (by IMGT; Q355R, N384S, K392N, V397M, R409K, E419Q, and V422I by EU) in the case of IgG4 antibodies. Variations on the bi-specific antibody format described above are contemplated within the scope of the present invention.

Therapeutic Administration and Formulations

The invention provides compositions (including pharmaceutical compositions) comprising the inventive anti-RSV-F and/or HMPV antibodies or antigen-binding fragments thereof or nucleic acid molecules encoding such antibodies or antigen-binding fragments thereof. The administration of compositions in accordance with the invention will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTIN™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-31 1.

The dose of each of the antibodies of the invention may vary depending upon the age and the size of a subject to be administered, target disease, conditions, route of administration, and the like. When the antibodies of the present invention are used for treating a RSV infection and/or HMPV infection in a patient, or for treating one or more symptoms associated with a RSV infection and/or HMPV infection, such as the cough or pneumonia associated with a RSV infection and/or HMPV in a patient, or for lessening the severity of the disease, it is advantageous to administer each of the antibodies of the present invention intravenously or subcutaneously normally at a single dose of about 0.01 to about 30 mg/kg body weight, more preferably about 0.1 to about 20 mg/kg body weight, or about 0.1 to about 15 mg/kg body weight, or about 0.02 to about 7 mg/kg body weight, about 0.03 to about 5 mg/kg body weight, or about 0.05 to about 3 mg/kg body weight, or about 1 mg/kg body weight, or about 3.0 mg/kg body weight, or about 10 mg/kg body weight, or about 20 mg/kg body weight. Multiple doses may be administered as necessary. Depending on the severity of the condition, the frequency and the duration of the treatment can be adjusted. In certain embodiments, the antibodies or antigen-binding fragments thereof of the invention can be administered as an initial dose of at least about 0.1 mg to about 800 mg, about 1 mg to about 600 mg, about 5 mg to about 300 mg, or about 10 mg to about 150 mg, to about 100 mg, or to about 50 mg. In certain embodiments, the initial dose may be followed by administration of a second or a plurality of subsequent doses of the antibodies or antigen-binding fragments thereof in an amount that can be approximately the same or less than that of the initial dose, wherein the subsequent doses are separated by at least 1 day to 3 days; at least one week, at least 2 weeks; at least 3 weeks; at least 4 weeks; at least 5 weeks; at least 6 weeks; at least 7 weeks; at least 8 weeks; at least 9 weeks; at least 10 weeks; at least 12 weeks; or at least 14 weeks.

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu et al. (1987) J. Biol. Chem. 262:4429-4432). Methods of introduction include, but are not limited to, intradermal, transdermal, intramuscular, intraperitoneal, intravenous, subcutaneous, intranasal, epidural and oral routes. The composition may be administered by any convenient route, for example by infusion or bolus injection, by absorption through epithelial or mucocutaneous linings {e.g., oral mucosa, nasal mucosa, rectal and intestinal mucosa, etc.) and may be administered together with other biologically active agents. Administration can be systemic or local. It may be delivered as an aerosolized formulation (See U.S. Publ. No. 2011/031 1515 and U.S. Publ. No. 2012/ 0128669). The delivery of agents useful for treating respiratory diseases by inhalation is becoming more widely accepted (See A. J. Bitonti and J. A. Dumont, (2006), Adv. Drug Deliv. Rev, 58:1 106-1118). In addition to being effective at treating local pulmonary disease, such a delivery mechanism may also be useful for systemic delivery of antibodies (See Maillet et al. (2008), Pharmaceutical Research, Vol. 25, No. 6, 2008).

The pharmaceutical composition can be also delivered in a vesicle, in particular a liposome (see, for example, Langer (1990) Science 249:1527-1533).

In certain situations, the pharmaceutical composition can be delivered in a controlled release system. In one embodiment, a pump may be used. In another embodiment, polymeric materials can be used. In yet another embodiment, a controlled release system can be placed in proximity of the composition's target, thus requiring only a fraction of the systemic dose.

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN 70/30™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™, OPTIPEN STARLET™, and OPTICLIK™ (Sanofi-Aventis, Frankfurt, Germany), to name only a few. Examples of disposable pen delivery devices having applications in subcutaneous delivery of a pharmaceutical composition of the present invention include, but certainly are not limited to the SOLOSTAR™ pen (Sanofi-Aventis), the FLEXPEN™ (Novo Nordisk), and the KWIKPEN™ (Eli Lilly), the SURECLICK™ Autoinjector (Amgen, Thousand Oaks, Calif.), the PENLET™ (Haselmeier, Stuttgart, Germany), the EPIPEN (Dey, L.P.) and the HUMIRA™ Pen (Abbott Labs, Abbott Park, Ill.), to name only a few.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, it is preferred that the aforesaid antibody is contained in about 5 to about 100 mg and in about 10 to about 250 mg for the other dosage forms.

Administration Regimens

According to certain embodiments, multiple doses of an antibody to RSV-F and/or HMPV, or a pharmaceutical composition comprising or encoding for these antibodies, may be administered to a subject over a defined time course. The methods according to this aspect of the invention comprise sequentially administering to a subject multiple doses of an antibody to RSV-F and/or HMPV, or sequentially administering to a subject multiple doses of a pharmaceutical composition comprising or encoding for an antibody of the invention or antigen binding fragment thereof. In one embodiment, nucleic acid sequences encoding for a heavy chain or light chain of an antibody of the invention (or antigen binding fragment thereof) are administered separately such that an antibody or antigen binding fragment thereof is expressed in the subject. In another embodiment, nucleic acid sequences encoding for a heavy chain and light chain of an antibody of the invention (or antigen binding fragment thereof) are administered together. As used herein, "sequentially administering" means that each dose of antibody to RSV-F and/or HMPV, or the pharmaceutical composition, is administered to the subject at a different point in time, e.g., on different days separated by a predetermined interval (e.g., hours, days, weeks or months). The present invention includes methods which comprise sequentially administering to the patient a single initial dose of an antibody to RSV-F and/or HMPV, or a composition comprising or encoding for the antibodies, followed by one or more secondary doses of the antibody to RSV-F and/or HMPV, or the composition, and optionally followed by one or more tertiary doses of the antibody to RSV-F and/or HMPV, or the composition.

The terms "initial dose," "secondary doses," and "tertiary doses," refer to the temporal sequence of administration of the antibody to RSV-F and/or HMPV or the compositions of the invention. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of antibody to RSV-F and/or HMPV, or nucleic acid sequence encoding at least one chain of such antibody (or antigen binding fragment thereof), but generally may differ from one another in terms of frequency of administration. In certain embodiments, however, the amount of antibody to RSV-F and/or HMPV, or nucleic acid sequence encoding at least one chain of such antibody (or antigen binding fragment thereof), contained in the initial, secondary and/or tertiary doses vary from one another (e.g., adjusted up or down as appropriate) during the course of treatment. In certain embodiments, two or more (e.g., 2, 3, 4, or 5) doses are administered at the beginning of the treatment regimen as "loading doses" followed by subsequent doses that are administered on a less frequent basis (e.g., "maintenance doses").

In one exemplary embodiment of the present invention, each secondary and/or tertiary dose is administered 1 to 26 (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) weeks after the immediately preceding dose. The phrase "the immediately preceding dose," as used herein, means, in a sequence of multiple administrations, the dose of antibody to RSV-F and/or HMPV, or nucleic acid sequence encoding at least one chain of such antibody (or antigen binding fragment thereof), which is administered to a patient prior to the administration of the very next dose in the sequence with no intervening doses.

The methods according to this aspect of the invention may comprise administering to a patient any number of secondary and/or tertiary doses of an antibody to RSV-F and/or HMPV or a nucleic acid sequence(s) encoding at least one chain of such antibody (or antigen binding fragment thereof). For example, in certain embodiments, only a single secondary dose is administered to the patient. In other embodiments, two or more (e.g., 2, 3, 4, 5, 6, 7, 8, or more) secondary doses are administered to the patient. Likewise, in certain embodiments, only a single tertiary dose is administered to the patient. In other embodiments, two or more (e.g., 2, 3, 4, 5, 6, 7, 8, or more) tertiary doses are administered to the patient.

In embodiments involving multiple secondary doses, each secondary dose may be administered at the same frequency as the other secondary doses. For example, each secondary dose may be administered to the patient 1 to 2 weeks after the immediately preceding dose. Similarly, in embodiments involving multiple tertiary doses, each tertiary dose may be administered at the same frequency as the other tertiary doses. For example, each tertiary dose may be administered to the patient 2 to 4 weeks after the immediately preceding dose. Alternatively, the frequency at which the secondary and/or tertiary doses are administered to a patient can vary over the course of the treatment regimen. The frequency of administration may also be adjusted during the course of treatment by a physician depending on the needs of the individual patient following clinical examination.

Accordingly, in certain embodiments are provided pharmaceutical compositions comprising: one or more of the inventive antibodies or antigen-binding fragments thereof disclosed herein and throughout and a pharmaceutically acceptable carrier and/or one or more excipients. In certain other embodiments are provided pharmaceutical compositions comprising: one or more nucleic acid sequences encoding one or more inventive antibodies or antigen-binding fragments thereof, e.g., a nucleic acid sequence(s) encoding one or more chains of an antibody or antigen-binding fragment thereof as disclosed herein; or one or more the expression vectors harboring such nucleic acid sequences; and a pharmaceutically acceptable carrier and/or one or more excipients.

Therapeutic Uses of the Antibodies and Pharmaceutical Compositions

Due to their binding to and interaction with the RSV fusion protein (RSV-F), it is believed that the inventive antibodies and antigen-binding fragments thereof, and pharmaceutical compositions encoding or comprising such antibodies, are useful—without wishing to be bound to any theory—for preventing fusion of the virus with the host cell membrane, for preventing cell to cell virus spread, and for inhibition of syncytia formation. Additionally, as Applicant has demonstrated herein that, surprisingly, a subset of the inventive anti-RSV antibodies and antigen-binding fragment thereof display cross-neutralizing potency against HMPV, the inventive antibodies and antigen-binding fragments thereof and pharmaceutical compositions are advantageous for preventing an infection of a subject with RSV and/or HMPV when administered prophylactically. Alternatively, the antibodies and pharmaceutical compositions of the present invention may be useful for ameliorating at least one symptom associated with the infection, such as coughing, fever, pneumonia, or for lessening the severity, duration, and/or frequency of the infection. The antibodies and pharmaceutical compositions of the invention are also contemplated for prophylactic use in patients at risk for developing or acquiring an RSV infection and/or HMPV infection. These patients include pre-term infants, full term infants born during RSV season (late fall to early spring), the elderly (for example, in anyone 65 years of age or older) and/or HMPV season, or patients immunocompromised due to illness or treatment with immunosuppressive therapeutics, or patients who may have an underlying medical condition that predisposes them to an RSV infection (for example, cystic fibrosis patients, patients with congestive heart failure or other cardiac conditions, patients with airway impairment, patients with COPD) and/or HMPV infection. It is contemplated that the antibodies and pharmaceutical compositions of the invention may be used alone, or in conjunction with a second agent, or third agent for treating RSV infection and/or HMPV infection, or for alleviating at least one symptom or complication associated with the RSV infection and/or HMPV infection, such as the fever, coughing, bronchiolitis, or pneumonia associated with, or resulting from such an infection. The second or third agents may be delivered concurrently with the antibodies (or pharmaceutical compositions) of the invention, or they may be administered separately, either before or after the antibodies (or pharmaceutical compositions) of the invention. The second or third agent may be an anti-viral such as ribavirin, an NSAID or other agents to reduce fever or pain, another second but different antibody that specifically binds RSV-F, an agent (e.g., an antibody) that binds to another RSV antigen, such as RSV-G, a vaccine against RSV, an siRNA specific for an RSV antigen.

In yet a further embodiment of the invention the present antibodies (or antigen binding fragments thereof) or nucleic acid sequence encoding at least one chain of such antibody (or antigen binding fragment thereof), are used for the preparation of a pharmaceutical composition for treating patients suffering from a RSV infection and/or HMPV infection. In yet another embodiment of the invention the present antibodies (or antigen-binding fragments thereof), or nucleic acid sequence encoding at least one chain of such antibody (or antigen binding fragment thereof), are used for the preparation of a pharmaceutical composition for reducing the severity of a primary infection with RSV and/or HMPV, or for reducing the duration of the infection, or for reducing at least one symptom associated with the RSV infection and/or the HMPV infection. In a further embodiment of the invention, the present antibodies (or pharmaceutical compositions comprising or encoding such antibodies) are used as adjunct therapy with any other agent useful for treating an RSV infection and/or and HMPV infection, including an antiviral, a toxoid, a vaccine, a second RSV-F antibody, or any other antibody specific for an RSV antigen, including an RSV-G antibody, or any other palliative therapy known to those skilled in the art.

Accordingly, in certain embodiments are provided methods of treating or preventing a Respiratory Syncytial Virus (RSV) infection, or at least one symptom associated with RSV infection, comprising administering to a patient in need thereof or suspected of being in need thereof one or more of the inventive antibodies or antigen-binding fragments thereof disclosed herein and throughout (or pharmaceutical compositions of the invention), such as, e.g., one or more of the anti-RSV antibodies disclosed in Table 6 or nucleic acid sequence encoding at least one chain of such antibody or antigen binding fragment thereof, such that the RSV infection is treated or prevented, or the at least on symptom associated with RSV infection is treated, alleviated, or reduced in severity.

In certain other embodiments are provided methods of treating or preventing a Respiratory Syncytial Virus (RSV) infection, or at least one symptom associated with RSV infection, comprising administering to a patient in need thereof or suspected of being in need thereof a nucleic acid sequence encoding at least one of a light chain or heavy chain of one or more of the inventive antibodies or antigen-binding fragments thereof, such as the nucleic acid sequences disclosed in Table 6 and compliments thereof, such that the RSV infection is treated or prevented, or the at least on symptom associated with RSV infection is treated, alleviated, or reduced in severity. In one embodiment, a pharmaceutical composition of the invention comprises a nucleic acid sequence encoding an antibody light chain or antigen-binding fragment thereof and a nucleic acid sequence encoding an antibody heavy chain or antigen-binding fragment thereof. In another embodiment, a first pharmaceutical composition of the invention comprises a nucleic acid sequence encoding an antibody light chain (or antigen binding fragment thereof) and a second pharmaceutical composition comprises a nucleic acid sequence encoding an antibody heavy chain (or antigen binding fragment thereof) such that upon coadministration of the first and second pharmaceutical compositions to the subject, an antibody of the invention or antigen binding fragment thereof is expressed in the subject.

In additional embodiments are provided methods of treating or preventing a Respiratory Syncytial Virus (RSV) infection, or at least one symptom associated with RSV infection, comprising administering to a patient in need thereof or suspected of being in need thereof a host cell harboring a nucleic acid sequence or an expression vector comprising such a nucleic acid sequence, wherein such nucleic acid sequences is selected from the group consisting of sequences disclosed in Table 6 and compliments thereof, such that the RSV infection is treated or prevented, or the at least on symptom associated with RSV infection is treated, alleviated, or reduced in severity.

In additional embodiments are provided methods of treating or preventing a Respiratory Syncytial Virus (RSV) infection, or at least one symptom associated with RSV infection, comprising administering to a patient in need thereof or suspected of being in need thereof a pharmaceutical composition comprising either: one or more of the inventive antibodies or antigen-binding fragments thereof as disclosed in Table 6; one or more nucleic acid sequences encoding at least one of a light chain or a heavy chain of an antibody of the invention or an antigen binding fragment thereof or an expression vectors comprising such a nucleic acid sequence(s), wherein such nucleic acid sequences are selected from the group consisting of sequences disclosed in Table 6 and compliments thereof, one or more host cells harboring one or more nucleic acid sequences or an expression vectors comprising such one or more nucleic acid sequences, wherein such nucleic acid sequences are selected from the group consisting of sequences disclosed in Table 6 and compliments thereof, and a pharmaceutically acceptable carrier and/or one or more excipients, such that the RSV infection is treated or prevented, or the at least on symptom associated with RSV infection is treated, alleviated, or reduced in severity.

In certain embodiments are provided methods of treating or preventing either a Respiratory Syncytial Virus (RSV) infection or a human metapneumovirus (HMPV) infection, or at least one symptom associated with said RSV infection or said HMPV infection, comprising administering to a patient in need thereof or suspected of being in need thereof one or more of the inventive antibodies or antigen-binding fragments thereof disclosed herein and throughout, such as, e.g., one or more of the anti-RSV antibodies disclosed in Table 6, or pharmaceutical compositions comprising or encoding such antibodies or antigen-binding fragments thereof, e.g., one or more nucleic acid molecules encoding such antibodies, such that the RSV infection is treated or prevented, or the at least on symptom associated with RSV infection is treated, alleviated, or reduced in severity. In certain embodiments, the one or more antibodies or antigen-binding fragments thereof is selected from the group consisting of the antibodies designated as Antibody Number 4, 11, and 62 as disclosed in Table 6 or one or more nucleic acid molecules encoding such antibodies.

In certain other embodiments are provided methods of treating or preventing either a Respiratory Syncytial Virus (RSV) infection and/or a human metapneumovirus (HMPV) infection, or at least one symptom associated with said RSV infection and/or said HMPV infection, comprising administering to a patient in need thereof or suspected of being in need thereof a nucleic acid sequence encoding one or more of the inventive antibodies or antigen-binding fragments thereof, e.g., encoding heavy or light chains of the antibodies, such nucleic acid sequences disclosed in Table 6 and compliments thereof, such that the RSV infection and/or the HMPV infection is treated or prevented, or the at least on symptom associated with RSV and/or HMPV infection is treated, alleviated, or reduced in severity. In certain embodiments, the one or more antibodies or antigen-binding fragments thereof, e.g., antibody light or heavy chains, is selected from the group consisting of the antibodies designated as Antibody Number Antibody Number 4, 11, and 62 as disclosed in Table 6. In one embodiment, a pharmaceutical composition of the invention comprises a nucleic acid sequence encoding an antibody light chain or antigen-binding fragment thereof and a nucleic acid sequence encoding an antibody heavy chain or antigen binding fragment thereof. In another embodiment, a first pharmaceutical composition of the invention comprises a nucleic acid sequence encoding an antibody light chain (or antigen binding fragment thereof) and a second pharmaceutical composition comprises a nucleic acid sequence encoding an antibody heavy chain (or antigen binding fragment thereof) such that upon coadministration of the first and second pharmaceutical compositions to the subject, an antibody of the invention or antigen binding fragment thereof is expressed in the subject.

In additional embodiments are provided methods of treating or preventing either a Respiratory Syncytial Virus (RSV) infection or a human metapneumovirus (HMPV) infection, or at least one symptom associated with said RSV infection or said HMPV infection, comprising administering to a patient in need thereof or suspected of being in need thereof a host cell harboring a nucleic acid sequence or an expression vector comprising such a nucleic acid sequence, wherein such nucleic acid sequences is selected from the group consisting of sequences disclosed in Table 6 and compliments thereof, such that the RSV infection is treated or prevented, or the at least on symptom associated with RSV infection is treated, alleviated, or reduced in severity. In certain embodiments, the one or more antibodies or antigen-binding fragments thereof of is selected from the group consisting of the antibodies designated as Antibody Number Antibody Number 4, 11, and 62 as disclosed in Table 6.

In additional embodiments are provided methods of treating or preventing either a Respiratory Syncytial Virus (RSV) infection or a human metapneumovirus (HMPV) infection, or at least one symptom associated with said RSV infection or said HMPV infection, comprising administering to a patient in need thereof or suspected of being in need thereof a pharmaceutical composition comprising either: one or more of the inventive antibodies or antigen-binding fragments thereof as disclosed in Table 6; one or more nucleic acid sequences or an expression vectors comprising such a nucleic acid sequence, wherein such nucleic acid sequences are selected from the group consisting of sequences disclosed in Table 6 and compliments thereof; one or more host cells harboring one or more nucleic acid sequences or an expression vectors comprising such one or more nucleic acid sequences, wherein such nucleic acid sequences are selected from the group consisting of sequences disclosed in Table 6 and compliments thereof; and a pharmaceutically acceptable carrier and/or one or more excipients, such that the RSV infection is treated or prevented, or the at least on symptom associated with RSV infection is treated, alleviated, or reduced in severity. In certain embodiments, the one or more antibodies or antigen-binding fragments thereof of is selected from the group consisting of the antibodies designated as Antibody Number Antibody Number 4, 11, and 62 as disclosed in Table 6.

Combination Therapies

As noted above, according to certain embodiments, the disclosed methods comprise administering to the subject one or more additional therapeutic agents in combination with an antibody to RSV-F and/or HMPV or a pharmaceutical composition of the invention. As used herein, the expression "in combination with" means that the additional therapeutic agents are administered before, after, or concurrent with the antibody or pharmaceutical composition of the invention. The term "in combination with" also includes sequential or concomitant administration of the anti-RSV-F antibody or pharmaceutical composition and a second therapeutic agent.

For example, when administered "before" the pharmaceutical composition comprising or encoding the anti-RSV-F and/or HMPV antibody, the additional therapeutic agent may be administered about 72 hours, about 60 hours, about 48 hours, about 36 hours, about 24 hours, about 12 hours, about 10 hours, about 8 hours, about 6 hours, about 4 hours, about 2 hours, about 1 hour, about 30 minutes, about 15 minutes or about 10 minutes prior to the administration of the pharmaceutical composition comprising or encoding the anti-RSV-F and/or HMPV antibody. When administered "after" the pharmaceutical composition comprising or encoding the anti-RSV-F and/or HMPV antibody, the additional therapeutic agent may be administered about 10 minutes, about 15 minutes, about 30 minutes, about 1 hour, about 2 hours, about 4 hours, about 6 hours, about 8 hours, about 10 hours, about 12 hours, about 24 hours, about 36 hours, about 48 hours, about 60 hours or about 72 hours after the administration of the pharmaceutical composition comprising or encoding the anti-RSV-F and/or HMPV antibodies. Administration "concurrent" or with the pharmaceutical composition comprising or encoding the anti-RSV-F and/or HMPV antibody means that the additional therapeutic agent is administered to the subject in a separate dosage form within less than 5 minutes (before, after, or at the same time) of administration of the pharmaceutical composition comprising or encoding the anti-RSV-F and/or HMPV antibody, or administered to the subject as a single combined dosage formulation comprising both the additional therapeutic agent and the anti-RSV-F antibody or pharmaceutical composition.

Combination therapies may include an anti-RSV-F and/or HMPV antibody or pharmaceutical composition of the invention and any additional therapeutic agent that may be advantageously combined with an antibody of the invention, or with a biologically active fragment of an antibody of the invention.

For example, a second or third therapeutic agent may be employed to aid in reducing the viral load in the lungs, such as an antiviral, for example, ribavirin. The antibodies or pharmaceutical compositions of the invention may also be used in conjunction with other therapies, as noted above, including a toxoid, a vaccine specific for RSV and/or HMPV, a second antibody specific for RSV-F, or an antibody specific for another RSV antigen, such as RSV-G.

Diagnostic Uses of the Antibodies

The inventive anti-RSV and/or HMPV antibodies and antigen-binding fragments thereof may also be used to detect and/or measure RSV and/or HMPV in a sample, e.g., for diagnostic purposes. It is envisioned that confirmation of an infection thought to be caused by RSV and/or HMPV may be made by measuring the presence of the virus through use of any one or more of the antibodies of the invention. Exemplary diagnostic assays for RSV and/or HMPV may comprise, e.g., contacting a sample, obtained from a patient, with an anti-RSV-F and/or HMPV antibody of the invention, wherein the anti-RSV-F and/or HMPV antibody is labeled with a detectable label or reporter molecule or used as a capture ligand to selectively isolate the virus containing the F protein from patient samples. Alternatively, an unlabeled anti-RSV-F and/or HMPV antibody can be used in diagnostic applications in combination with a secondary antibody which is itself detectably labeled. The detectable label or reporter molecule can be a radioisotope, such as $^3$H, $^{14}$C, $^{32}$P, $^{35}$S, or $^{125}$I; a fluorescent or chemiluminescent moiety such as fluorescein isothiocyanate, or rhodamine; or an enzyme such as alkaline phosphatase, β-galactosidase, horseradish peroxidase, or luciferase. Specific exemplary assays that can be used to detect or measure RSV containing the F protein and/or HMPV in a sample include enzyme-linked immunosorbent assay (ELISA), radioimmunoassay (RIA), and fluorescence-activated cell sorting (FACS).

Samples that can be used in RSV and/or HMPV diagnostic assays according to the present invention include any tissue or fluid sample obtainable from a patient, which contains detectable quantities of RSV-F protein and/or HMPV, or fragments thereof, under normal or pathological conditions. Generally, levels of RSV-F and/or HMPV in a particular sample obtained from a healthy patient (e.g., a patient not afflicted with a disease or condition associated with the presence of RSV-F and/or HMPV) will be measured to initially establish a baseline, or standard, level of the F protein from RSV and/or HMPV. This baseline level of RSV-F and/or HMPV can then be compared against the levels of RSV-F and/or HMPV measured in samples obtained from individuals suspected of having an RSV and/or HMPV infection, or symptoms associated with such infection.

Examples

Applicant has comprehensively profiled the human antibody response to RSV fusion protein (F) by isolating and characterizing 123 RSV F-specific monoclonal antibodies from the memory B cells of a healthy adult donor, and used these antibodies to comprehensively map the antigenic topology of RSV F. The antibody response to RSV F was determined to be comprised of a broad diversity of clones that target several antigenic sites. Nearly half of the most potent antibodies target a previously undefined site of vulnerability near the apex of the prefusion conformation of RSV F (preF), providing strong support for the development of RSV antibodies that target this region, as well as vaccine candidates that preserve the membrane-distal hemisphere of the preF protein. Additionally, this class of antibodies displayed convergent sequence features, thus providing a future means to rapidly detect these types of antibodies in human samples. Many of the antibodies that bound preF-specific surfaces from this donor were over 100 times more potent than palivizumab and several cross-neutralized human metapneumovirus (HMPV). Taken together, the results have implications for the design and evaluation of RSV vaccine and antibody-based therapeutic candidates, and offer new options for passive prophylaxis.

Large-Scale Isolation of RSV F-Specific Monoclonal Antibodies from Healthy Adult Human Donors In order to comprehensively profile the human antibody response to RSV F, Applicant isolated and characterized 123 monoclonal antibodies from the memory B cells of a healthy adult donor ("donor 076"). Although this donors did not have a documented history of RSV infection, healthy adults are expected to have had multiple RSV infections throughout life (26).

Figure 6B:
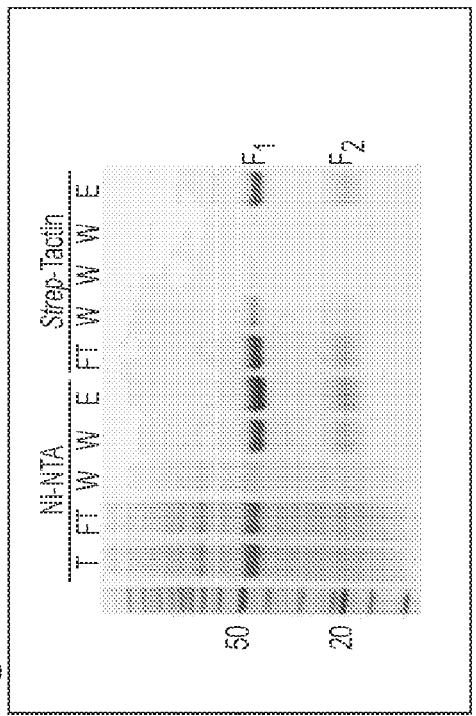
FIGS. 6A-6C illustrate the nature and purification of pre- and postF sorting probes.
Figure 6C:
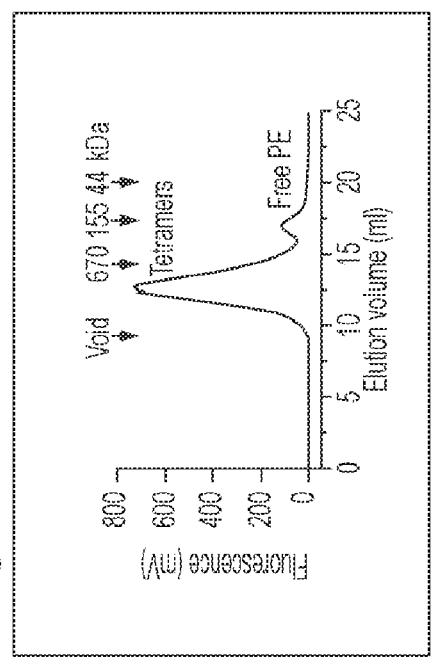
Figure 6A:
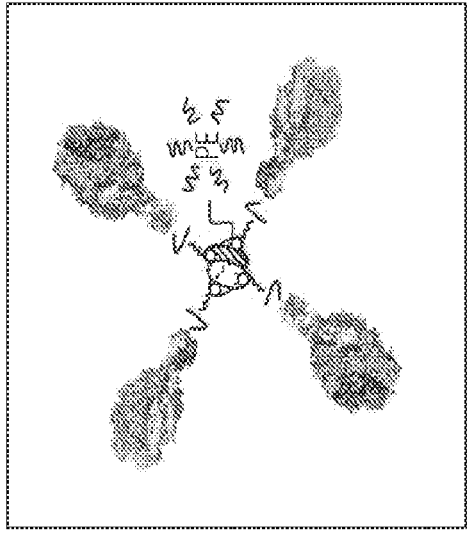

The magnitude of the memory B cell response in this donor to RSV F was assessed by staining peripheral B cells with a mixture of fluorescently labeled pre- and postfusion RSV F sorting probes (FIG. 6A through 6B) (11, 15). Both proteins were dual-labeled in order to eliminate background due to non-specific fluorochrome binding (27). Flow cytometric analysis revealed that 0.04-0.18% of class-switched (IgG+ and IgA+) peripheral B cells were specific for RSV F (FIG. 1A and Figure B), which is significantly lower than the percentage of RSV F-specific cells observed after experimental RSV infection and suggests that this donor was probably not recently exposed to RSV (28). Notably, index sorting showed that 17-38% of circulating RSV F-specific B cells express IgA, indicating that IgA memory B cells to RSV F are present in peripheral blood (FIG. 1B).

Approximately 200 RSV F-specific B cells were single-cell sorted from the donor sample, and antibody variable heavy (VH) and variable light (VL) chain genes were rescued by single-cell PCR (29). One hundred twenty-three (123) cognate heavy and light chain pairs were subsequently cloned and expressed as full-length IgGs in an engineered strain of *Saccharomyces cerevisiae* for further characterization (30). Preliminary binding studies showed that approximately 80% of antibodies cloned from RSV F glycoprotein (F)-specific B cells bound to recombinant RSV F proteins.

Sequence Analysis of RSV F-Specific Antibody Repertoires

Sequence analysis of the isolated monoclonal antibodies revealed that the RSV-F specific repertoire was highly diverse, containing over 70 unique lineages (FIG. 1C and Table 2). This result is in stark contrast to the relatively restricted repertoires observed in HIV-infected patients (31), or in healthy donors after influenza vaccination (32). Compared to non-RSV-reactive antibodies (33), the RSV F-specific repertoires were skewed, generally, toward certain VH germline genes (VH1-18, VH1-2, VH1-69, VH3-21, VH3-30, VH4-304, and VH5-51) (FIG. 1D and Table 2) and longer heavy chain third complementarity-determining region (CDRH3) lengths (generally, approximately 14-18 amino acids in length; FIG. 1E and Table 2). Interestingly, a bias toward VH1-69 has also been observed in anti-HIV-1, anti-influenza, and anti-HCV repertoires (34-36), and recent studies have shown that there is a significant increase in the relative usage of VH1-18, VH1-2, and VH1-69 during acute dengue infection (37). Hence, it appears that these particular germline gene segments may have inherent properties that facilitate recognition of viral envelope proteins.

The average level of somatic hypermutation (SHM) ranged generally between 16 and 30 nucleotide substitutions per VH gene (excluding CDRH3) (FIG. 1F and Table 2), which is comparable to the average level of SHM observed in anti-influenza antibody repertoires (32, 38) and consistent with the recurrent nature of RSV infection (26). Interestingly, several antibodies contained 60 or greater VH gene nucleotide substitutions, suggesting that multiple rounds of RSV infection can result in antibodies with very high levels of somatic hypermutation (SHM).

A Large Proportion of Antibodies Bind Exclusively to PreF

We next measured the apparent binding affinities of the IgGs to furin-cleaved RSV F ectodomains stabilized in the prefusion (DS-Cav1) or postfusion (F ΔFP) conformation using biolayer interferometry (11, 15). A relatively large proportion of the antibodies (36-67%) bound exclusively to preF (FIG. 2A and Figure B; Table 3). The vast majority of remaining antibodies bound to both pre- and postF, with only 5-7% of antibodies showing exclusive postF specificity (FIG. 2A and Figure B; Table 3). The low prevalence of postF-specific antibodies in these donor repertoires is consistent with the observation that less than 10% of anti-RSV F serum-binding activity specifically targets postF (8). Interestingly, however, the majority of cross-reactive antibodies bound with higher apparent affinity to postF (FIG. 2A; Table 3), suggesting that these antibodies were probably elicited by and/or affinity matured against postF in vivo. Hence, the significantly higher proportion of preF- versus postF-specific antibodies is likely due to the higher immunogenicity of the unique surfaces on preF compared to postF, rather than an increased abundance of preF in vivo. Finally, as expected based on the relatively high degree of sequence conservation between RSV subtypes, most of the antibodies showed binding reactivity to F proteins derived from both subtypes A and B (FIG. 2C; Table 3).

Since certain antiviral antibody specificities have been associated with poly- and autoreactivity (39-41), we also tested the RSV antibodies for polyreactivity using a previously described high-throughput assay that correlates with down-stream behaviors such as serum clearance (42, 43). One hundred and seventy-seven clinical antibodies, as well as several broadly neutralizing HIV antibodies, were also included for comparison. Interestingly, in contrast to many previously described HIV broadly neutralizing antibodies, the vast majority of RSV F-specific antibodies lacked significant polyreactivity in this assay (FIG. 2D).

RSV F-Specific Antibodies Target Six Major Antigenic Sites

To map the antigenic specificities of the RSV F-specific antibodies, Applicant first performed competitive binding experiments using a previously described yeast-based assay (44). Antibodies were initially tested for competition with D25, AM14 and MPE8—three previously described preF-specific antibodies (10, 17, 21)—and motavizumab, an affinity-matured variant of palivizumab that binds to both pre- and postF (10, 11, 45). Non-competing antibodies were then tested for competition with a site IV-directed mAb (101F) (46), a site I-directed antibody (Site I Ab), and two high affinity antibodies (High Affinity Ab I and High Affinity Ab 2, respectively) that did not strongly compete with each other or any of the control antibodies. Each antibody was assigned a bin based on the results of this competition assay (see, e.g., Table 4).

In order to confirm and increase the resolution of our epitope assignments, the binding of each antibody to a panel of preF variants was measured using a luminex-based assay. Each variant contained 2-4 mutations clustered together to form a patch on the surface of preF. A total of nine patches that uniformly covered the surface of preF were generated (FIG. 7A through FIG. 7C). Deglycosylated preF was also included to identify antibodies targeting glycan-dependent epitopes. Binding of each antibody to the 10 preF variants was compared to that of wild-type preF and used to assign a patch (see, e.g., Table 4). Previously characterized antibodies D25, AM14 and motavizumab were used to validate the assay (see, e.g., FIG. 7C and Table 4). The combined bin and patch data were then used to assign each antibody to a single antigenic site (FIG. 3A through FIG. 3G), which were defined based on previously determined structures, resistance mutations, and secondary structure elements of the F protein. Overall, these data show that the large majority of isolated antibodies target six dominant antigenic sites on prefusion RSV F (Ø, I, II, III, IV, and V). Interestingly, only a small proportion of the isolated antibodies had binding profiles similar to that of AM14, suggesting that antibodies targeting this quaternary epitope are not commonly elicited during natural infection. None of the antibodies were sensitive to deglycosylation of F, demonstrating that glycan-dependent antibodies are also rarely elicited by natural RSV infection.

Figure 8:
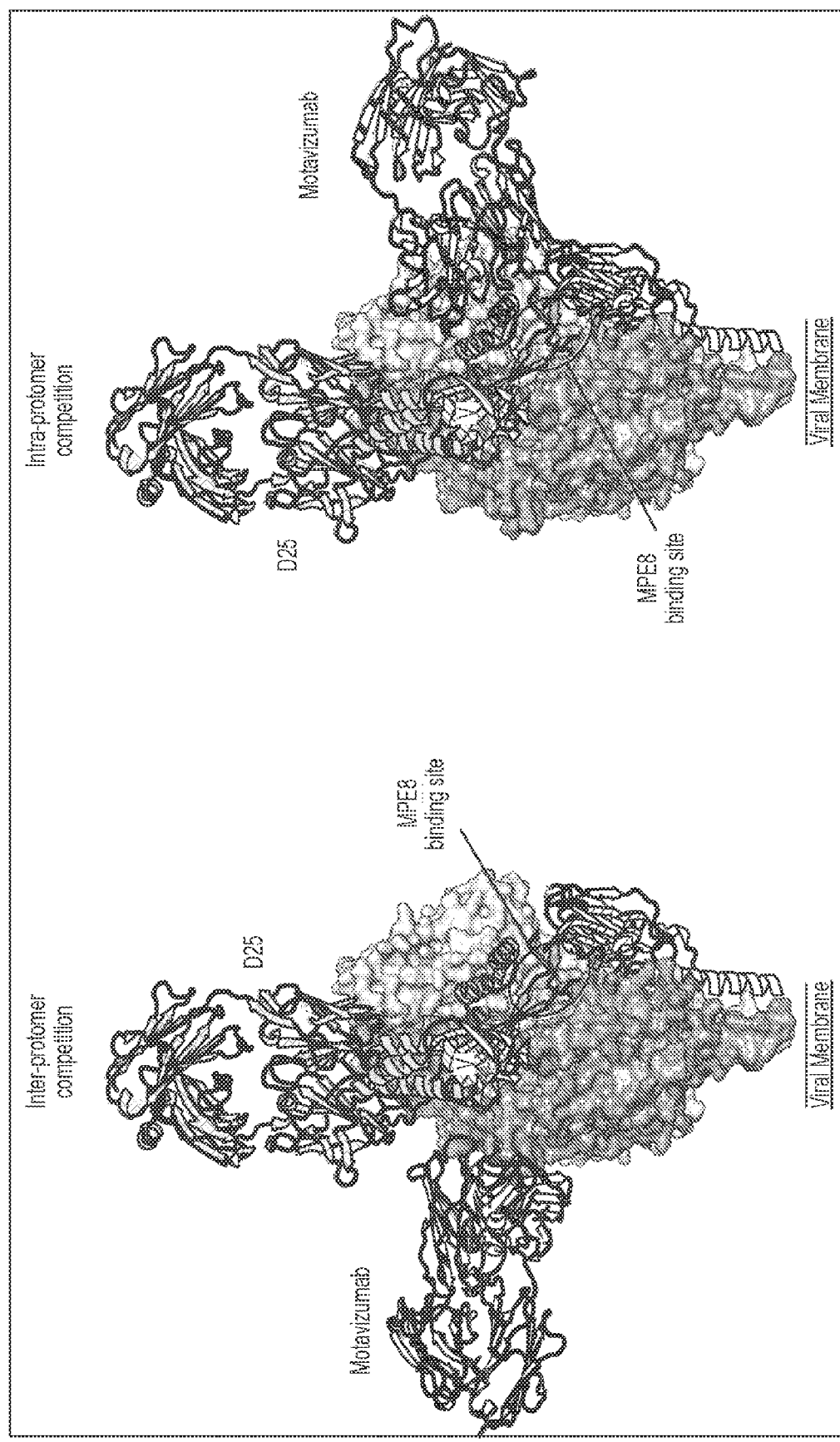
FIG. 8 illustrates the antigenic site V resides between the epitopes recognized by D25, MPE8 and motavizumab. Prefusion F is shown with one promoter as a cartoon colored according to antigenic site location and the other two protomers colored grey. D25 and motavizumab Fabs are shown in blue and pink, respectively. The MPE8 binding site is circled in black. Antigenic site V is located between the binding sites of D25 and MPE8 within one protomer, explaining the competition between site-V directed antibodies and these controls. Competition with motavizumab may occur across two adjacent protomers (left) or within one protomer (right), depending on the angle-of-approach of these site-V directed antibodies.

Analysis of the preF- and postF-binding activities of the antibodies targeting each antigenic site (see, e.g., FIG. 3C through FIG. 3G; Table 4) revealed that three sites are primarily found on preF (Ø, III, and V). Antibodies targeting site Ø and site III have been previously described (10, 17), and these sites are located on the top and side of the preF spike, respectively. Approximately 4% of the antibodies from this donor recognized site Ø and approximately 6% recognized site III. A relatively large proportion of antibodies from this donor (approximately 20%) recognized the third preF-specific site, which has not been previously described and therefore has been designated herein as region site V (See, e.g., FIG. 3C through FIG. 3G; Table 4). The majority of site V antibodies competed with D25, MPE8 and motavizumab, which was unexpected given the distance between the epitopes recognized by these three antibodies. The patch mutant analysis revealed that these antibodies interact with the α3 helix and β3/β4 hairpin of preF. This region is located between the epitopes recognized by D25, MPE8, and motavizumab, explaining the unusual competition profile observed for this class of antibodies (See, e.g., FIG. 8). In addition to the three primarily preF-specific sites, a large number of the antibodies that recognized antigenic site IV were preF-specific, likely due to contacts with β22, which dramatically rearranges during the transition from pre- to postF. In summary, the epitope mapping data show that the large majority of isolated antibodies target six dominant antigenic sites, approximately half of which are exclusively expressed on preF.

Highly Potent Neutralizing Antibodies Target preF-Specific Epitopes

Figure 4A:
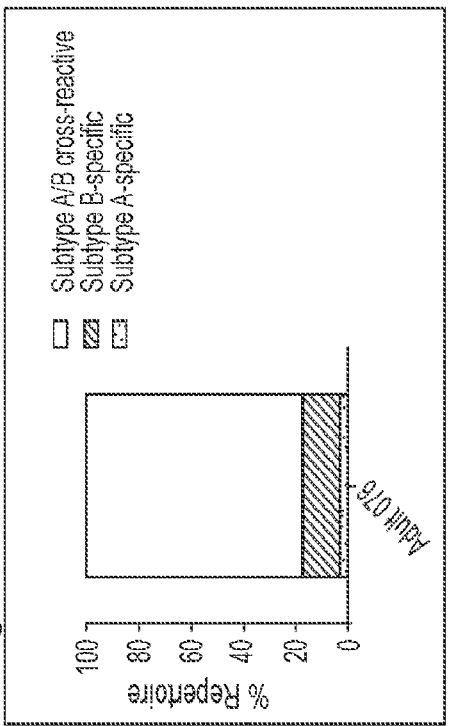
FIGS. 4A-4G illustrate neutralizing potencies of anti-RSV antibodies and correlation between potency and Pref vs. PostF specificity for each of RSV subtypes A and B.
Figure 4C:
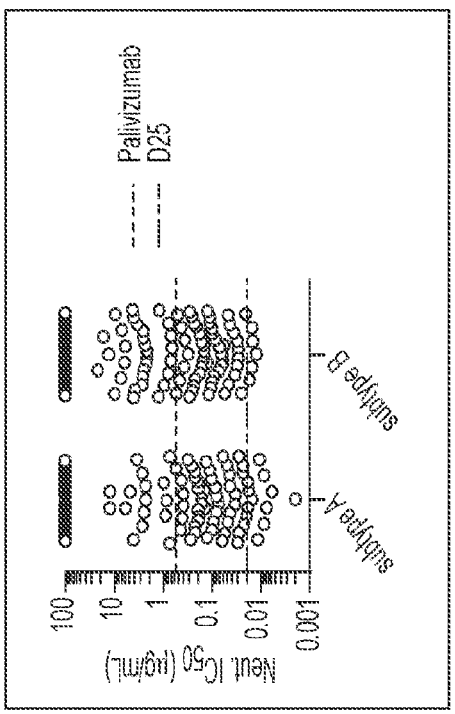
Figure 4B:
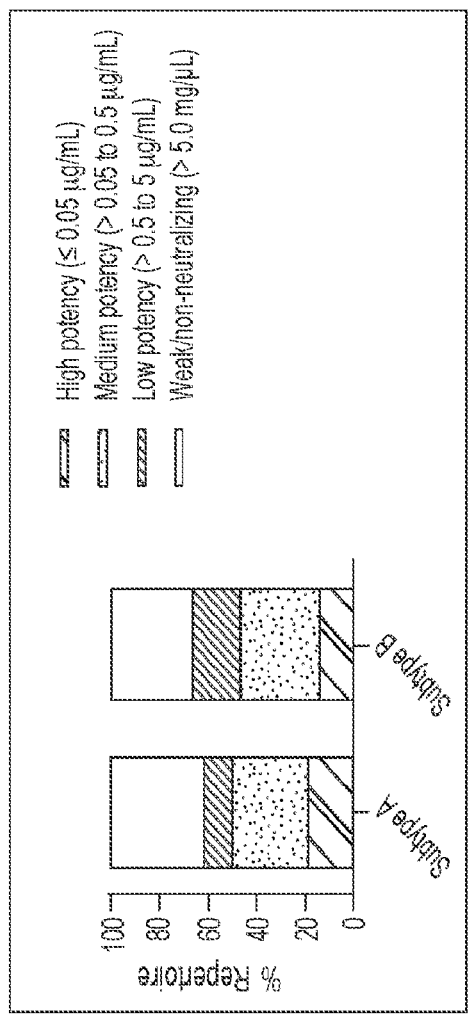
Figure 4D:
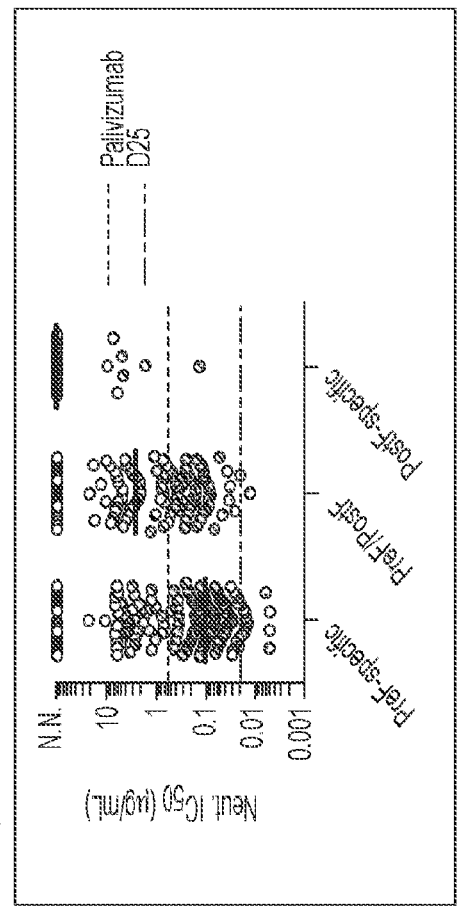
Figure 4E:
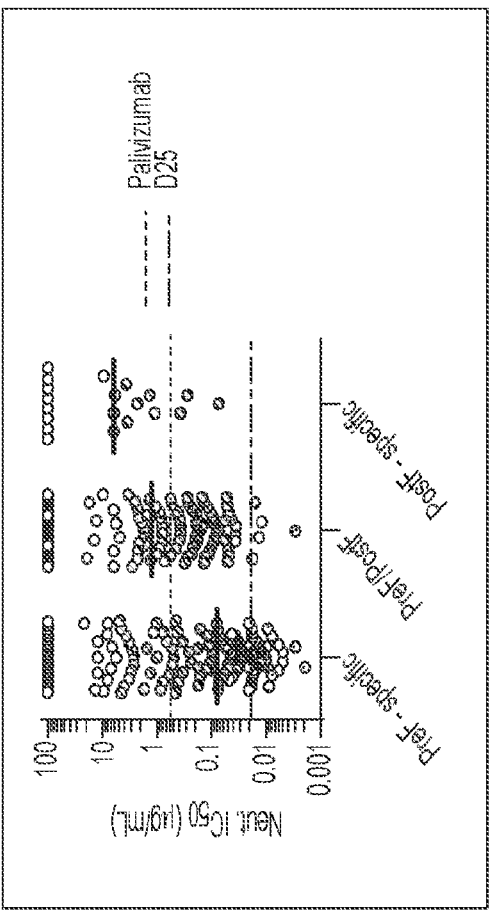
Figure 4F:
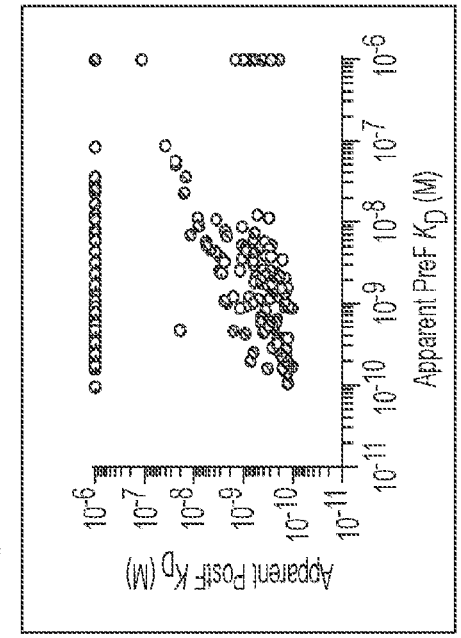
Figure 4G:
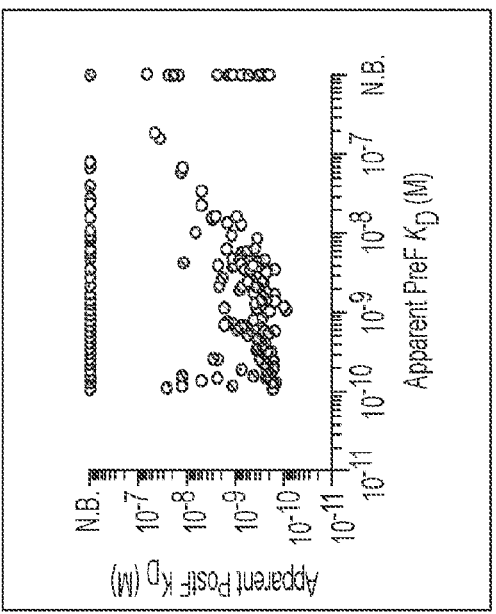

The antibodies were next tested for neutralizing activity against RSV subtypes A and B using a previously described high-throughput neutralization assay (15). Greater than 60% of the isolated antibodies showed neutralizing activity, and approximately 20% neutralized with high potency ($IC_{50} \leq 0.05$ μg/ml) (see, e.g., FIG. 4A and FIG. 4B; Table 3). Notably, several clonally unrelated antibodies were ≥5.0-fold more potent than D25 and ≥100-fold more potent than palivizumab (see, e.g., FIG. 4A; Table 3). Interestingly, there was no correlation between neutralization potency and level of SHM, suggesting that extensive SHM is not required for potent neutralization of RSV. Consistent with the binding cross-reactivity data, the majority of neutralizing antibodies showed activity against both subtype A and B (FIG. 4A through FIG. 4C; Table 3).

Figure 5B:
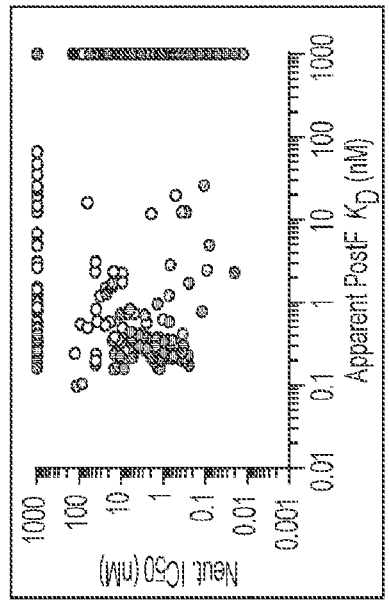
FIGS. 5A-5C illustrate that the most potent neutralizing antibodies bind with high affinity to preF and recognize antigenic sites Ø and V.
Figure 5A:
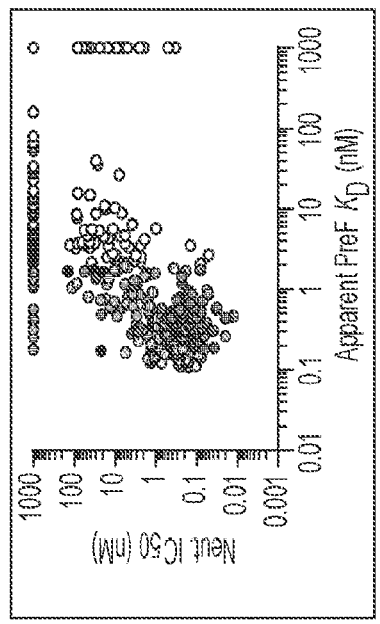
Figure 9:
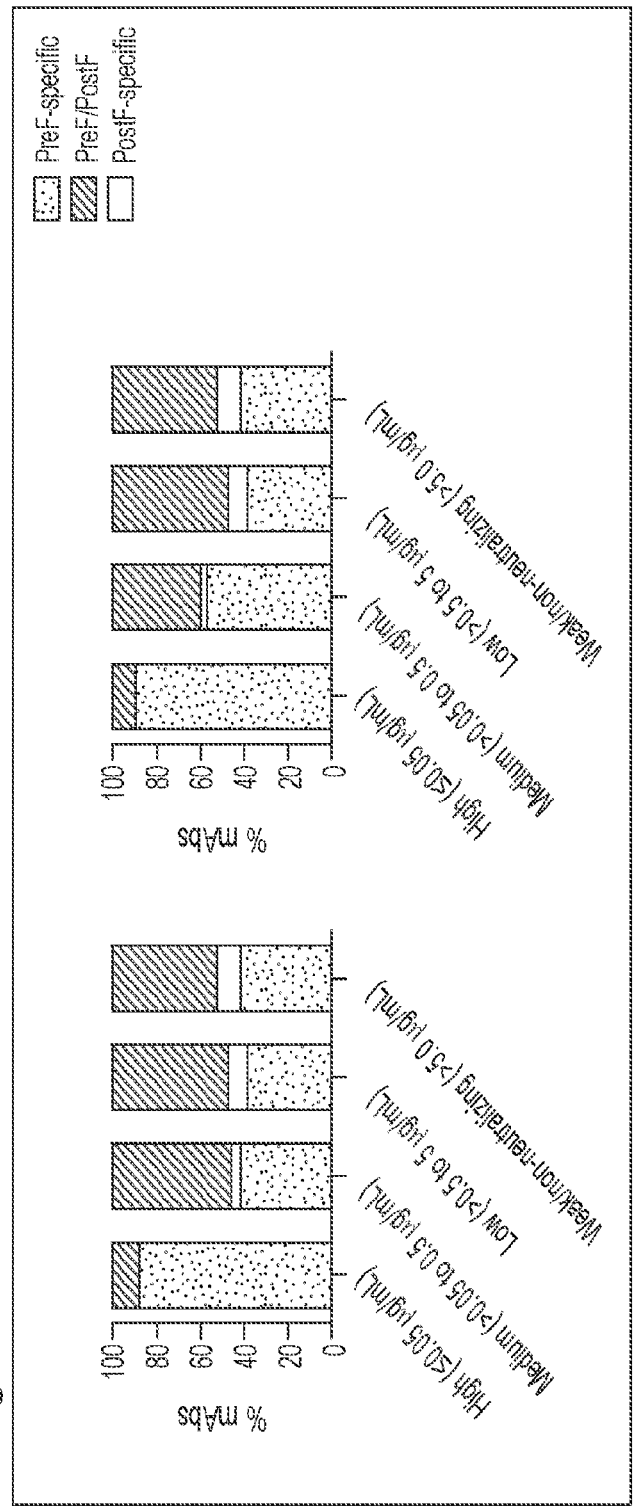
FIG. 9 illustrates percentage of anti-RSV antibodies demonstrating the indicated neutralizing activities of preF-specific, postF-specific, and cross-reactive antibodies. Antibodies were stratified according to neutralization potency and the percentage of antibodies in each group that were preF-specific (pink), postF-specific (white) or cross-reactive (orange) were plotted for subtype A (left panel) and subtype B (right panel).

The relationship between preF- and postF-binding affinity and neutralization potency was next investigated, which clearly demonstrated that the majority of highly potent antibodies bound preferentially or exclusively to preF (see, e.g., FIG. 4D through FIG. 4G; Table 3). Quantifying this difference revealed that more than 80% of highly potent antibodies ($IC_{50} < 0.05$ μg/ml) were specific for preF (See, e.g., FIG. 9; Table 3) and that the median $IC_{50}$ for preF-specific antibodies was more than 8-fold lower than for pre- and postF cross-reactive antibodies and 80-fold lower than antibodies that specifically recognized postF (see, e.g., FIG. 4E; Table 3). Importantly, there was a positive correlation between preF binding and neutralization (P<0.001, r=0.24), and the apparent preF $K_{DS}$ generally corresponded well with the neutralization $IC_{50}$s (see, e.g., FIG. 5A; Table 3). In contrast, there was no correlation between neutralization potency and postF affinity (P=0.44, r=−0.07) (see, e.g., FIG. 5B; Table 3). This result is compatible with the occupancy model of antibody-mediated neutralization (47), and suggests that DS-Cav1 is a faithful antigenic mimic of the native preF trimer. Notably, very few antibodies neutralized with $IC_{50}$s lower than 100 pM, which is consistent with the previously proposed ceiling to affinity maturation (48, 49).

Figure 5C:
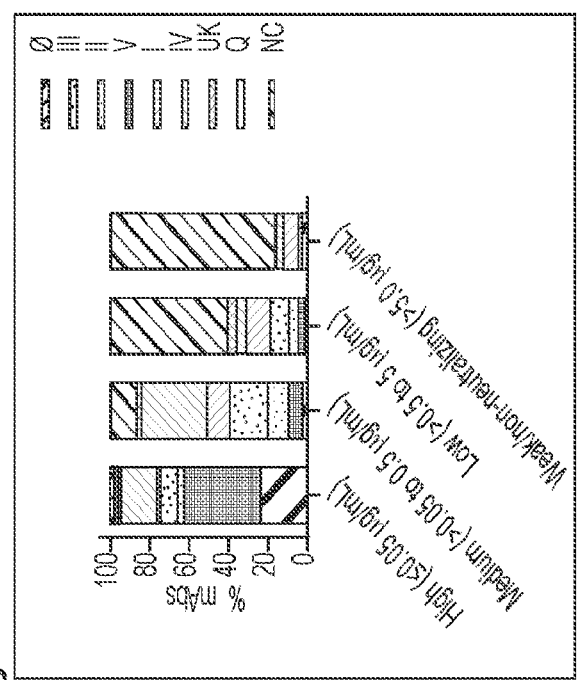
Figure 10B:
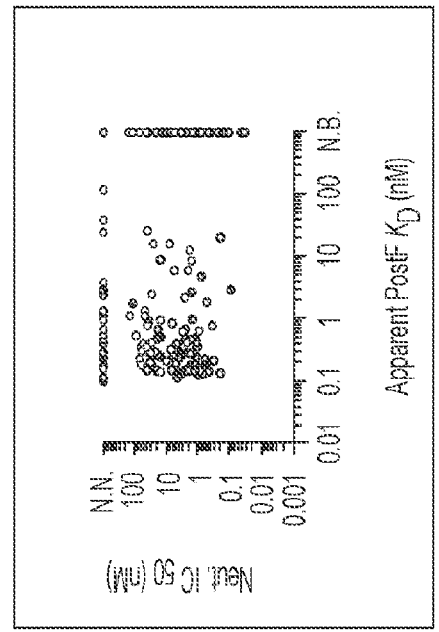
FIGS. 10A-10C illustrate the relationship between subtype B neutralization and antigenic site specificity for anti-RSV antibodies.
Figure 10A:
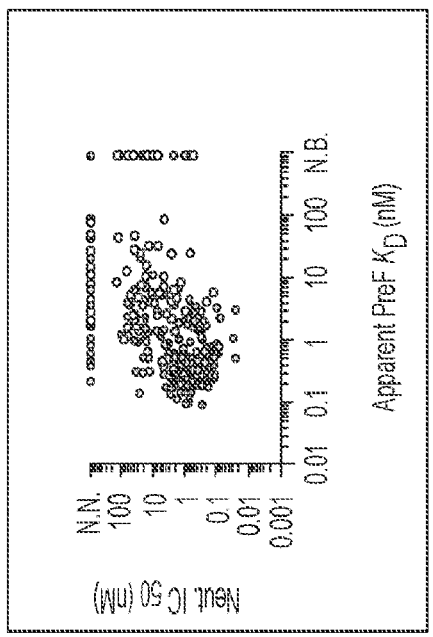
Figure 10C:
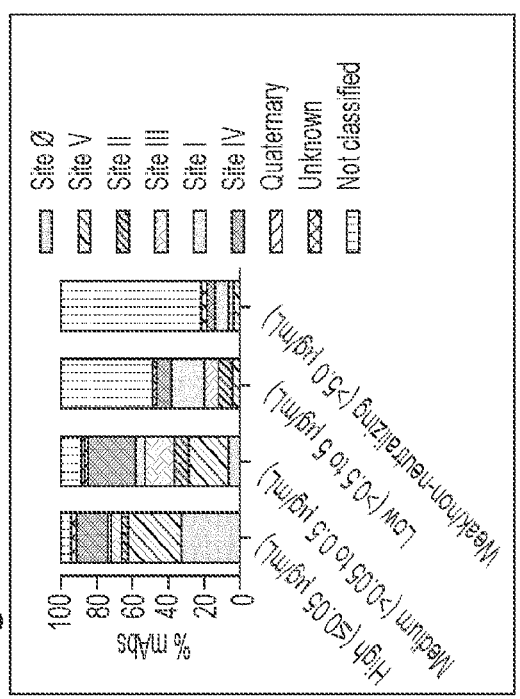

The relationship between neutralization potency and antigenic site was next analyzed. The results, provided in, e.g., FIG. 5C, Table 3, and Table 4, collectively, indicated that over 60% of the highly potent neutralizing antibodies targeted antigenic sites Ø and V, which are two of the three prefusion-F specific sites. In contrast, antibodies targeting sites III and IV showed a wide range of neutralization potencies, and antibodies targeting sites I and II were generally moderate to non-neutralizing. Similar results were obtained using binding affinities and neutralization potencies measured for subtype B (See, e.g., FIG. 10A through FIG. 10C; Table 3 and Table 4). Interestingly, a subset of site IV-directed antibodies neutralized with substantially lower potency than would be expected based on preF binding affinity (see, e.g., FIG. 5A; Table 3). This result may suggest that certain epitopes within site IV are less exposed in the context of the native envelope spike expressed on the crowded surface of the virion than on recombinant preF.

Several Antibodies Cross-Neutralize RSV and HMPV

Given that the RSV and human metapneumovirus (HMPV) F proteins share 33% amino acid identity, and certain RSV F-specific antibodies cross-neutralize HMPV (17, 50), the antibodies from this donor were tested for neutralizing activity against HMPV. Of the 123 antibodies tested, three neutralized HMPV (see, e.g., Table 5). Sequence analysis revealed that the three antibodies represent two different clonal families, which utilize different VH germline genes and have varying CDRH3 lengths and levels of somatic hypermutation (See, e.g., Table 2 and sequence listing). All of the cross-neutralizing antibodies bound exclusively to preF and competed with MPE8 (See, e.g., Table 5), in agreement with previous studies indicating that MPE8 cross-neutralizes four pneumoviruses, including RSV and HMPV (17). This result suggests, inter alia, that highly conserved epitopes are relatively immunogenic in the context of natural RSV and/or HMPV infection.

Discussion

An in-depth understanding of the human antibody response to RSV infection will aid the development and evaluation of RSV vaccine and therapeutic and/or prophylactic antibody candidates for the treatment and/or prevention of RSV infection. Although previous studies have coarsely mapped the epitopes targeted by RSV-specific neutralizing antibodies in human sera (4, 8), the specificities and functional properties of antibodies induced by natural RSV infection have remained largely undefined. As disclosed herein, preF- and postF-stabilized proteins (11, 15), a high-throughput antibody isolation platform, and a structure-guided collection of prefusion F mutants, were used to clonally dissect the human memory B cell response to RSV F in a naturally infected adult donor, and highly potent and selective RSV-neutralizing—as well as highly potent anti-RSV/anti-HMPV cross-selective and cross-neutralizing—were isolated and characterized.

Figure 2B:
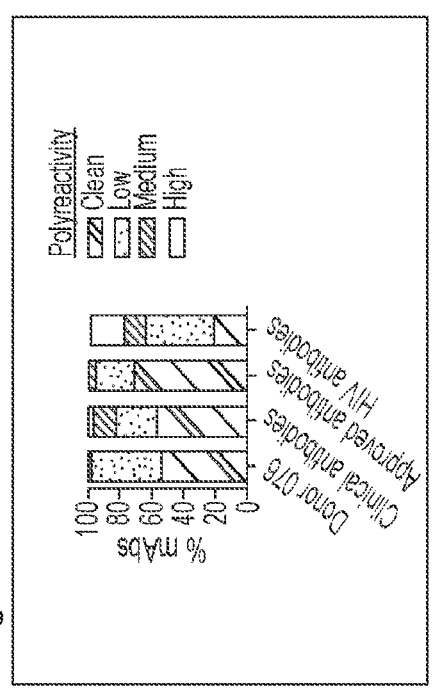
Figure 2C:
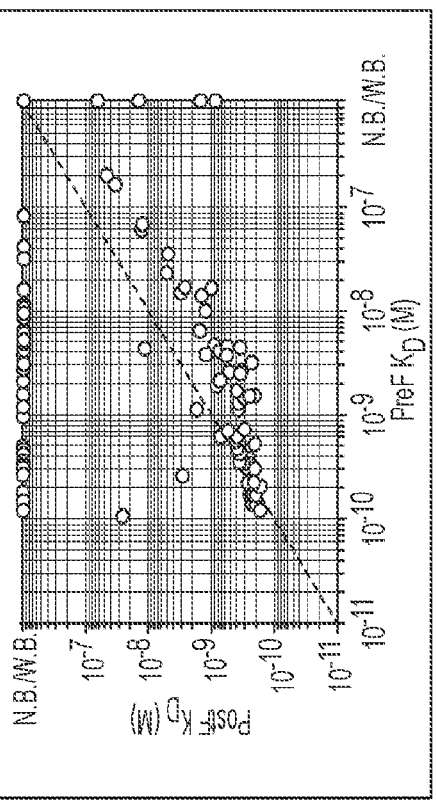
Figure 2D:
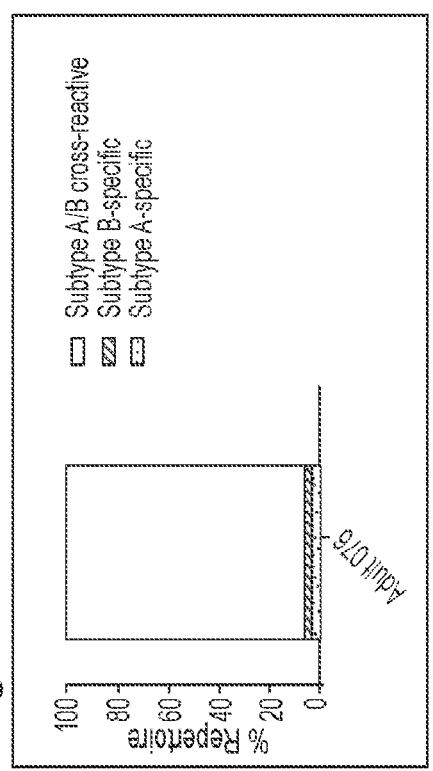
Figure 3D:
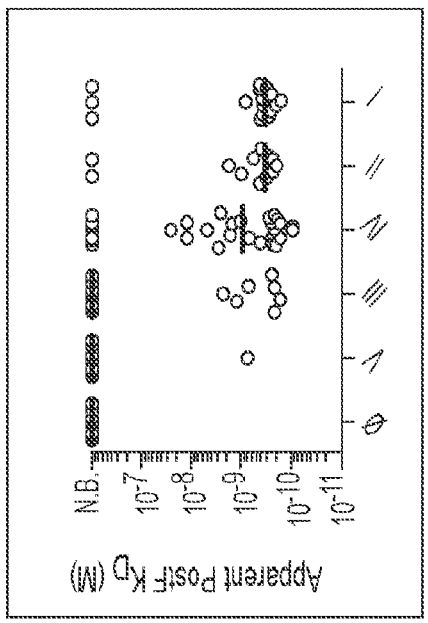
Figure 3F:
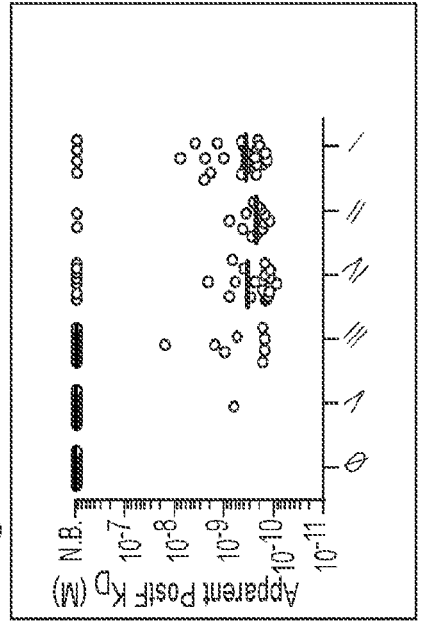
Figure 3E:
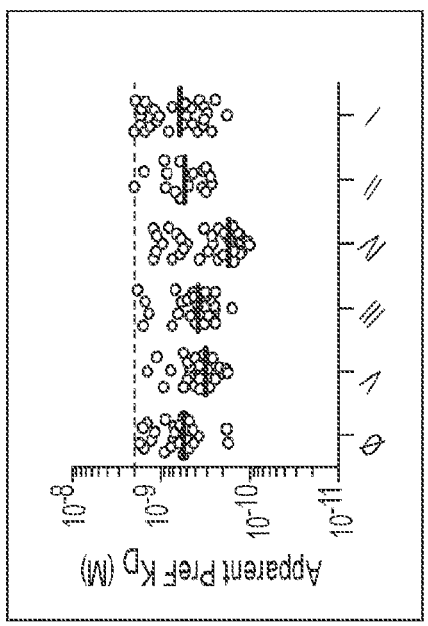
Figure 3G:
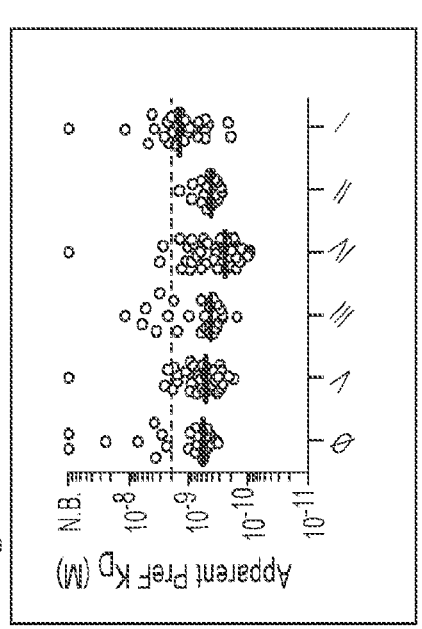

In the repertoire analyzed, the ratio of preF-specific antibodies to those that recognize both pre- and postF was slightly greater than 1:1 (See, e.g., FIG. 2B). These values are somewhat lower than those reported for human sera, which showed approximately 70% of anti-F serum binding is specific for preF (8). This discrepancy may be the result of differences between the levels of individual antibodies in serum, differences in the B cell phenotypes achieved for a particular specificity, or variation between donors. Despite these minor differences, the results of both studies suggest that preF-specific epitopes and epitopes shared by pre- and postF are immunogenic during natural RSV infection, whereas the unique surfaces on postF are significantly less immunogenic.

The repertoire analysis disclosed herein revealed that the large majority of RSV F-specific antibodies target six dominant antigenic sites on prefusion RSV F: Ø, I, II, III, IV, and V. These sites were defined based on previously determined structures, epitope binning/competition assays, resistance mutations, and secondary structure elements of the preF protein. It is important to note that the nomenclature for describing RSV F antigenic sites has evolved over time (6, 51-57), and previous mapping efforts were based on the postfusion conformation of F and did not include surfaces present exclusively on preF. The crystal structure of preF has provided critical information about F structure and function as well as new reagents to map antibody binding sites on the unique surfaces of preF and surfaces shared with postF. To a first approximation, each antibody can be assigned primarily to one of these sites. However, it is likely that antibody epitopes cover the entire surface of F and that there are antibodies that bind two or more adjacent antigenic sites within a protomer and quaternary antibodies that bind across protomers.

Importantly, the results disclosed herein show that the most potently neutralizing antibodies target antigenic sites Ø and V, both of which are located near the apex of the preF trimer. These findings are consistent with results obtained from human sera mapping, which determined that the majority of neutralizing activity can be removed by pre-incubation with preF (4, 8) and that preF-specific sites other than site Ø make up a considerable fraction of preF-specific neutralizing antibodies (8). Although antigenic site Ø has been shown to be a target of potently neutralizing antibodies (8, 10), the interaction of antibodies with site V is less well understood. Interestingly, it was found that the majority of site V-directed antibodies share several convergent sequence features, suggesting that it may be possible to rapidly detect these types of antibodies in human samples using high-throughput sequencing technology (58). Applicant anticipates this finding to be particularly advantageous in profiling antibody responses to RSV vaccine candidates that aim to preserve the apex of the preF trimer.

The extensive panel of antibodies described here provides new opportunities for passive prophylaxis, as well as for treatment of RSV infection. A large number of these antibodies neutralize RSV more potently than D25, which serves as the basis for MEDI8897—a monoclonal antibody that is currently in clinical trials for the prevention of RSV in young, at risk children (59). Additionally, a sub-set of these antibodies were demonstrated to cross-neutralize HMPV.

The development of an effective RSV vaccine has presented a number of unique challenges, and selection of the optimal vaccination strategy will be of the utmost importance. The in-depth analysis of the human antibody response to natural RSV infection presented here provides insights for the development of such a vaccine. Importantly, the results suggest that immunization of pre-immune donors with preF immunogens would be expected to boost neutralizing responses, whereas the use of postF immunogens would likely expand B cell clones with moderate or weak neutralizing activity. Similarly, immunization of RSV naïve infants with preF immunogens would be expected to activate naïve B cells targeting epitopes associated with substantially more potent neutralizing activity compared to postF immunogens. In addition, the ideal RSV vaccine should preserve antigenic sites Ø and V, since these sites are targeted by the most highly potent antibodies elicited in response to natural RSV infection.

Accordingly, disclosed herein are highly selective and potent anti-RSV antibodies, nucleic acids molecules encoding these antibodies, as well as highly potent cross-neutralizing anti-RSV and anti-HMPV antibodies, as well as vaccine candidates, for the treatment and or prophylaxis of RSV and/or HMPV infection. Additionally, the reagents disclosed here provide a useful set of tools for the evaluation of clinical trials, which will be critical for selecting the optimal RSV vaccination or antibody-based therapeutic strategy from the many currently under investigation (60).

TABLE 1

Antigenic sites targeted by prototypic RSV antibodies

| Antigenic site | Prototypic antibodies |
| --- | --- |
| Ø | D25, 5C4, AM22 (10,16) |
| I | 131-2a, 2F |
| II | 1129, palivizumab, motavisumab (6) |
| III | MPE8 (17) |
| IV | 101F (57), mAb 19 (19) |

TABLE 2

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
| --- | --- | --- | --- | --- | --- | --- | --- | --- |
| ADI-14438 | 1 | VH1-8 | VK1-5 | ARPDINWGQDAFDV (SEQ ID NO: 1969) | QQYKSDPT (SEQ ID NO: 1970) | 38 | 31 | 13 |
| ADI-14439 | 2 | VH1-69 | VK3-20 | AIIDPQDCTAASCFWVNWLDP (SEQ ID NO: 1971) | QQYGSAPIT (SEQ ID NO: 1972) | 3 | 42 | 16 |

TABLE 2 -continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-14440 | 3 | VH1-69 | VK3-20 | AIIDPQ LCTRAS CFWVN WLDP (SEQ ID NO: 1973) | QQFGA LPIT (SEQ ID NO: 1974) | 3 | 31 | 14 |
| ADI-14441 | 4 | VH1-69 | VK3-15 | ATAGW FGESVH LDS (SEQ ID NO: 1975) | QQYNN WPPLT (SEQ ID NO: 1976) | 54 | 29 | 2 |
| ADI-14442 | 5 | VH1-18 | VK2-30 | ARDVP ADGVH FMDV (SEQ ID NO: 1977) | MQGSH WAPT (SEQ ID NO: 1978) | 22 | 15 | 6 |
| ADI-14443 | 6 | VH1-69 | VK2-40 | ATKRY CSDPSC HGLWY FDL (SEQ ID NO: 1979) | MQRVE FPYT (SEQ ID NO: 1980) | 56 | 20 | 3 |
| ADI-14444 | 7 | VH1-46 | VL2-14 | ARIGSNEI (SEQ ID NO: 1981) | CSFTSS GSRV (SEQ ID NO: 1982) | 34 | 38 | 16 |
| ADI-14445 | 8 | VH1-69 | VK3-20 | AIIDPQ DCTRA SCFWV NWLDP (SEQ ID NO: 1983) | QQYDS APIT (SEQ ID NO: 1984) | 3 | 43 | 16 |
| ADI-14446 | 9 | VH1-69 | VK2-40 | ATKRY CTSPSC HGLWY FNL (SEQ ID NO: 1985) | MQRIE YPYT (SEQ ID NO: 1986) | 56 | 28 | 5 |
| ADI-14447 | 10 | VH1-69 | VK1-16 | AGSLL AGYDR EFDS (SEQ ID NO: 1987) | QQYYT YPLT (SEQ ID NO: 1988) | 1 | 29 | 12 |
| ADI-14448 | 11 | VH3-21 | VL1-40 | VRHMN LVMGP FAFDI (SEQ ID NO: 1989) | QSYDRI GMYV (SEQ ID NO: 1990) | 68 | 30 | 9 |
| ADI-14449 | 12 | VH3-15 | VL1-47 | STGPPY KYFDE TGYSV VDY (SEQ ID NO: 1991) | AAWDD NLSGPV (SEQ ID NO: 1992) | 60 | 13 | 17 |
| ADI-14450 | 13 | VH3-15 | VL1-47 | STGPPY SYFDST GYSVVDY (SEQ ID NO: 1993) | AAWDD SLSGPV (SEQ ID NO: 1994) | 60 | 25 | 16 |
| ADI-14451 | 14 | VH1-2 | VL3-19 | ARSQQ LLVITD | NCRDSS GHRLV | 44 | 21 | 15 |

TABLE 2 -continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| | | | | YSLDY (SEQ ID NO: 1995) | (SEQ ID NO: 1996) | | | |
| ADI-14452 | 15 | VH1-69 | VK2-40 | ATKRYCTSPSCHGLWYFNL (SEQ ID NO: 1997) | MQRVEYPYS (SEQ ID NO: 1998) | 56 | 26 | 4 |
| ADI-14453 | 16 | VH2-5 | VK1-39 | AHIGLYDRGGYYLFYFDF (SEQ ID NO: 1999) | QHTYTTPYI (SEQ ID NO: 2000) | 2 | 14 | 15 |
| ADI-14454 | 17 | VH2-5 | VK1-39 | VHSDLYDSGGYYLYYFDY (SEQ ID NO: 2001) | QQAYSAPYT (SEQ ID NO: 2002) | 65 | 13 | 12 |
| ADI-14455 | 18 | VH1-18 | VK2-30 | ARDVPVIAAGTMDY (SEQ ID NO: 2003) | MQGPHWPRT (SEQ ID NO: 2004) | 23 | 3 | 0 |
| ADI-14456 | 19 | VH1-2 | VK1-39 | AKDRAASVHVPAGAFDL (SEQ ID NO: 2005) | QQSFTIPSIT (SEQ ID NO: 2006) | 6 | 32 | 13 |
| ADI-14457 | 20 | VH2-70 | VK1-39 | ARTLYYTSGGYYLNLFDY (SEQ ID NO: 2007) | QQSYSSTPT (SEQ ID NO: 2008) | 46 | 29 | 20 |
| ADI-14458 | 21 | VH3-15 | VL1-47 | TTGPPYSYFDSTGYSIVDY (SEQ ID NO: 2009) | ASWDDSLSGPV (SEQ ID NO: 2010) | 60 | 12 | 15 |
| ADI-14459 | 22 | VH3-15 | VL1-47 | STGPPYKYHDSTGYSVVDY (SEQ ID NO: 2011) | AMWDDSLNGPV (SEQ ID NO: 2012) | 60 | 7 | 7 |
| ADI-14460 | 23 | VH4-34 | VL2-14 | TRSETSDYFDSSGYAFHI (SEQ ID NO: 2013) | GSYTDTNRL (SEQ ID NO: 2014) | 63 | 32 | 13 |
| ADI-14461 | 24 | VH3-30 | VL2-8 | ARDQWLVPDY (SEQ ID NO: 2015) | SSYAGSNSV (SEQ ID NO: 2016) | 18 | 8 | 5 |
| ADI-14462 | 25 | VH3-33 | VL2-14 | ATERMWEENSSSFGW (SEQ ID NO: 2017) | TSYTSRSSYV (SEQ ID NO: 2018) | 55 | 19 | 8 |

TABLE 2 -continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-14463 | 26 | VH1-18 | VK2-30 | ARDVPVMGAAFLDY (SEQ ID NO: 2019) | MQGTHWPPT (SEQ ID NO: 2020) | 24 | 31 | 16 |
| ADI-14464 | 27 | VH1-18 | VK1-39 | AKDRAASVHVPAGEFDL (SEQ ID NO: 2021) | QQSYTIPSIT (SEQ ID NO: 2022) | 6 | 28 | 9 |
| ADI-14465 | 28 | VH4-34 | VL3-21 | ARQRLEHTASGYYMDV (SEQ ID NO: 2023) | QVWDNSSDQPV (SEQ ID NO: 2024) | 40 | 30 | 22 |
| ADI-14466 | 29 | VH5-a | VK4-1 | ARHKENYDFWDF (SEQ ID NO: 2025) | QQYFTSTF (SEQ ID NO: 2026) | 32 | 18 | 20 |
| ADI-14467 | 30 | VH1-18 | VK2-30 | VRDVPVISGASTMDY (SEQ ID NO: 2027) | MQATQWPRT (SEQ ID NO: 2028) | 67 | 20 | 3 |
| ADI-14468 | 31 | VH2-5 | VK1-39 | VKSDLYDRGGYYLYYFDH (SEQ ID NO: 2029) | QQTFSSPYT (SEQ ID NO: 2030) | 65 | 27 | 24 |
| ADI-14469 | 32 | VH2-5 | VK1-39 | VKSDLYDRGGYYLYYFDY (SEQ ID NO: 2031) | QQTFSSPYT (SEQ ID NO: 2032) | 65 | 18 | 22 |
| ADI-14470 | 33 | VH2-70 | VK1-39 | VRSSVYASNAYYLYYFDS (SEQ ID NO: 2033) | QQAYSSPYT (SEQ ID NO: 2034) | 70 | 13 | 12 |
| ADI-14471 | 34 | VH1-69 | VK2-40 | ATKRYCSDPSCHGLWYFDL (SEQ ID NO: 2035) | MQRAEFPYT (SEQ ID NO: 2036) | 56 | 19 | 2 |
| ADI-14473 | 35 | VH5-a | VK4-1 | ARHKENYDFWDF (SEQ ID NO: 2037) | QQYYSSAF (SEQ ID NO: 2038) | 32 | 8 | 10 |
| ADI-14474 | 36 | VH1-18 | VK2-30 | ARDVPVMGAAFLDY (SEQ ID NO: 2039) | MQGTHWPPT (SEQ ID NO: 2040) | 24 | 35 | 14 |
| ADI-14475 | 37 | VH2-70 | VK1-39 | VRTPIYASGGYYLSYFDS (SEQ ID NO: 2041) | QQSYSTPYT (SEQ ID NO: 2042) | 70 | 10 | 15 |

TABLE 2 -continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-14476 | 38 | VH2-5 | VK1-39 | VHSDRYDRGGYYLYFFDY (SEQ ID NO: 2043) | QQSYTSPYT (SEQ ID NO: 2044) | 65 | 17 | 15 |
| ADI-14477 | 39 | VH2-5 | VK1-39 | VHSDLYDRGGYYLFYFDD (SEQ ID NO: 2045) | QQSYTFPYT (SEQ ID NO: 2046) | 65 | 15 | 14 |
| ADI-14478 | 40 | VH3-11 | VL1-40 | ARDQRDQAVAGRWFDP (SEQ ID NO: 2047) | QSYDNSLSGSAV (SEQ ID NO: 2048) | 17 | 2 | 5 |
| ADI-14479 | 41 | VH1-2 | VK2-28 | ARTMWRWLVEGGFEN (SEQ ID NO: 2049) | MQALQTPLT (SEQ ID NO: 2050) | 47 | 23 | 2 |
| ADI-14480 | 42 | VH1-69 | VK3-15 | ATAGWFGELVRFDS (SEQ ID NO: 2051) | QQYNNWPPLT (SEQ ID NO: 2052) | 54 | 48 | 8 |
| ADI-14482 | 43 | VH4-34 | VL3-21 | ARSSGTYNFEYWFDP (SEQ ID NO: 2053) | QVWDDPSDHAV (SEQ ID NO: 2054) | 8 | 22 | 11 |
| ADI-14483 | 44 | VH3-21 | VL1-40 | ARDWGGHSIFGAVQDL (SEQ ID NO: 2055) | QSYDRSLSQV (SEQ ID NO: 2056) | 26 | 29 | 2 |
| ADI-14484 | 45 | VH2-70 | VK1-39 | ARTLYYTSGGYYLNLFDY (SEQ ID NO: 2057) | QQSYSSTPT (SEQ ID NO: 2058) | 46 | 29 | 20 |
| ADI-14485 | 46 | VH1-69 | VK3-15 | ARPEGDFGDLKWLRSPFDY (SEQ ID NO: 2059) | QQYDDWPPQLT (SEQ ID NO: 2060) | 39 | 28 | 7 |
| ADI-14486 | 47 | VH4-304 | VL2-14 | ARHPSVIYGTFGANGGPNWFDP (SEQ ID NO: 2061) | SSYTGSNTVI (SEQ ID NO: 2062) | 33 | 18 | 8 |
| ADI-14487 | 48 | VH1-2 | VK2-28 | ARVTWQWLVLGGFDY (SEQ ID NO: 2063) | MQALHTPLT (SEQ ID NO: 2064) | 52 | 17 | 2 |
| ADI-14488 | 49 | VH3-73 | VL2-14 | TLGYCSGDSCSS | SSYTSSSTLV | 62 | 11 | 1 |

TABLE 2 -continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| | | | | LRDY (SEQ ID NO: 2065) | (SEQ ID NO: 2066) | | | |
| ADI-14489 | 50 | VH1-18 | VK2-30 | ARDVP ADGVH FMDV (SEQ ID NO: 2067) | MQGSH WAPT (SEQ ID NO: 2068) | 22 | 14 | 6 |
| ADI-14490 | 51 | VH3-33 | VL1-40 | ARDAIF GSGPN WFDP (SEQ ID NO: 2069) | QSYESS LRGWV (SEQ ID NO: 2070) | 9 | 4 | 1 |
| ADI-14491 | 52 | VH3-30 | VL2-8 | ARDQW LVPDY (SEQ ID NO: 2071) | SSYAGS NSV (SEQ ID NO: 2072) | 18 | 8 | 5 |
| ADI-14492 | 53 | VH3-15 | VL1-47 | TTGPPY QYFDD SGYSV VDY (SEQ ID NO: 2073) | AAWDD SLGGPV (SEQ ID NO: 2074) | 60 | 15 | 14 |
| ADI-14493 | 54 | VH4-34 | VL3-21 | AKASS GSYHFE YWFDP (SEQ ID NO: 2075) | QVWDD ADDHAV (SEQ ID NO: 2076) | 4 | 25 | 22 |
| ADI-14494 | 55 | VH3-30 | VL2-8 | ARDQW LVPDY (SEQ ID NO: 2077) | SSYAGS NSV (SEQ ID NO: 2078) | 18 | 8 | 5 |
| ADI-14495 | 56 | VH2-5 | VK1-39 | VHSDL YDRGG YYLFYFDY (SEQ ID NO: 2079) | QQSYTF PYT (SEQ ID NO: 2080) | 65 | 12 | 14 |
| ADI-14496 | 57 | VH5-51 | VK1-33 | GRQEL QGSFTI (SEQ ID NO: 2081) | QHYDN LLLFT (SEQ ID NO: 2082) | 59 | 17 | 9 |
| ADI-14497 | 58 | VH2-5 | VK1-39 | VHSDL YDSGG YYLYY FDY (SEQ ID NO: 2083) | QQVYT SPYT (SEQ ID NO: 2084) | 65 | 13 | 15 |
| ADI-14498 | 59 | VH2-5 | VK1-39 | VHSDL YDRNA YYLHY FDF (SEQ ID NO: 2085) | QQSYSI PYT (SEQ ID NO: 2086) | 65 | 11 | 7 |
| ADI-14499 | 60 | VH2-5 | VK1-39 | VHSDL YDSSG YYLYY FDY (SEQ ID NO: 2087) | QQSYTS PYT (SEQ ID NO: 2088) | 65 | 19 | 11 |
| ADI-14500 | 61 | VH3-15 | VL1-47 | TTGPPY KYSDST | AAWDD RLSGPV | 60 | 13 | 2 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| | | | | GYSVVDY (SEQ ID NO: 2089) | (SEQ ID NO: 2090) | | | |
| ADI-14501 | 62 | VH1-69 | VK3-15 | ATAGW FGELVR FDS (SEQ ID NO: 2091) | QQYNN WPPLT (SQ ID NO: 2092) | 54 | 34 | 4 |
| ADI-14502 | 63 | VH1-69 | VK1-12 | ARVAG LGNSY GRYFDV (SEQ ID NO: 2093) | QQAKS FPYT (SEQ ID NO: 2094) | 49 | 14 | 15 |
| ADI-14503 | 64 | VH3-21 | VL3-21 | AREGS DTEYW RLTPPMDV (SEQ ID NO: 2096) | QVWDS GDHPWL (SEQ ID NO: 2095) | 27 | 21 | 9 |
| ADI-14504 | 65 | VH3-48 | VK3-15 | ARDLS GSPAYS GSWV (SEQ ID NO: 2097) | QQYDR WPPWT (SEQ ID NO: 2098) | 14 | 8 | 3 |
| ADI-14505 | 66 | VH1-2 | VK4-1 | ASEPPG VGFGLI PHYYFDN (SEQ ID NO: 2099) | QQYFSI PPT (SEQ ID NO: 2100) | 53 | 13 | 8 |
| ADI-14506 | 67 | VH1-69 | VK3-15 | ARPAG DFGDL KWVRS PFDY (SEQ ID NO: 2101) | QEYND WPPQLS (SEQ ID NO: 2102) | 37 | 30 | 11 |
| ADI-14507 | 68 | VH2-5 | VK1-39 | VHSDV YTTGG YYLYY FDY (SEQ ID NO: 2103) | QQSYSS PYT (SEQ ID NO: 2104) | 65 | 11 | 12 |
| ADI-14508 | 69 | VH1-18 | VK2-30 | ARDSG ATAAGI LWDY (SEQ ID NO: 2105) | MQATH WPRT (SEQ ID NO: 2106) | 19 | 41 | 8 |
| ADI-14509 | 70 | VH1-18 | VK2-30 | ARDVP ADGVH FMDV (SEQ ID NO: 2107) | MEGSH WAPT (SEQ ID NO: 2108) | 22 | 26 | 11 |
| ADI-14510 | 71 | VH1-69 | VK3-20 | AIIDPQ DCTSAS CFWVN WLDP (SEQ ID NO: 2109) | QQYGT SPIT (SEQ ID NO: 2110) | 3 | 39 | 17 |
| ADI-14511 | 72 | VH1-69 | VK3-15 | ARPAG DFGDL KWLRS PFDY (SEQ ID NO: 2111) | QQYND WPPQLT (SEQ ID NO: 2112) | 37 | 22 | 6 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-14512 | 73 | VH1-69 | VK3-15 | ARPERDFGHLKWLRSPFDY (SEQ ID NO: 2113) | QQYNDWPPQLT (SEQ ID NO: 2114) | 39 | 22 | 5 |
| ADI-14513 | 74 | VH1-69 | VK3-20 | AIIDPQDCTRASCFWVNWLAP (SEQ ID NO: 2115) | QQYGSAPIT (SEQ ID NO: 2116) | 3 | 37 | 15 |
| ADI-14514 | 75 | VH1-18 | VK2-30 | ARDVPGDGVHFMDV (SEQ ID NO: 2117) | MEGSHWAPT (SEQ ID NO: 2118) | 22 | 22 | 10 |
| ADI-14515 | 76 | VH3-30 | VK3-15 | ARNTIFGVVDY (SEQ ID NO: 2119) | QQYNNWPPWT (SEQ ID NO: 2120) | 36 | 16 | 6 |
| ADI-14516 | 77 | VH1-18 | VK2-30 | ARDKGVTVAGSLLDY (SEQ ID NO: 2121) | MESTHWPPYT (SEQ ID NO: 2122) | 12 | 16 | 2 |
| ADI-14518 | 78 | VH1-18 | VK2-30 | ARDSPSDTAAALLDF (SEQ ID NO: 2123) | MQATHWPRLS (SEQ ID NO:2124) | 21 | 38 | 4 |
| ADI-14519 | 79 | VH1-24 | VK1-39 | ATVIAVGAYDI (SEQ ID NO: 2125) | QQSYIIPYT (SEQ ID NO: 2126) | 58 | 31 | 13 |
| ADI-14520 | 80 | VH4-34 | VL3-21 | ARASSGSYNFEYWFDP (SEQ ID NO: 2127) | QVWDDPSDHAV (SEQ ID NO: 2128) | 8 | 15 | 10 |
| ADI-14521 | 81 | VH1-18 | VK2-30 | ARDPPSLTAAGTLDY (SEQ ID NO: 2129) | MQATDWPRT (SEQ ID NO: 2130) | 16 | 16 | 5 |
| ADI-14522 | 82 | VH1-2 | VK3-15 | ARDLYSSGWLDN (SEQ ID NO: 2131) | HQYNDWPYT (SEQ ID NO: 2132) | 15 | 26 | 10 |
| ADI-14523 | 83 | VH3-15 | VL1-47 | STGPPYSYFDSSGYSVVDY (SEQ ID NO: 2133) | AAWDDSLSGPV (SEQ ID NO: 2134) | 60 | 18 | 14 |
| ADI-14524 | 84 | VH3-48 | VK3-20 | VRSLHWGAAIERWDV (SEQ ID NO: 2135) | QQSGSSPYT (SEQ ID NO: 2136) | 69 | 14 | 8 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| ADI-14525 | 85 | VH3-30 | VL2-8 | ARDQW LVPDY (SEQ ID NO: 2137) | SSYAGS NSV (SEQ ID NO: 2138) | 18 | 9 | 5 |
| ADI-14526 | 86 | VH4-304 | VL3-25 | ARGRG YSYGW RYFDS (SEQ ID NO: 2139) | QSSDSS GNYVV (SEQ ID NO: 2140) | 30 | 33 | 11 |
| ADI-14527 | 87 | VH1-69 | VK3-20 | AIIDPQ DCTAA SCFWV NWLDP (SEQ ID NO: 2141) | QQYGS SPIT (SEQ ID NO: 2142) | 3 | 46 | 11 |
| ADI-14528 | 88 | VH1-69 | VK3-15 | ARPAG DFGDL KWVRS PFDY (SEQ ID NO: 2143) | QEYND WPPQLT (SEQ ID NO: 2144) | 37 | 29 | 8 |
| ADI-14529 | 89 | VH3-15 | VL1-40 | STGPPY SYFDSS GYSVVDY (SEQ ID NO: 2145) | AAWDD SLSGPV (SEQ ID NO: 2146) | 60 | 18 | 22 |
| ADI-14530 | 90 | VH1-69 | VK3-15 | ARPEG DFGDL KWVRS PFDY (SEQ ID NO: 2147) | QEYND WPPQLT (SEQ ID NO: 2148) | 39 | 26 | 8 |
| ADI-14531 | 91 | VH1-69 | VK3-20 | AIIDPQ DCTRA SCFWV NWLAP (SEQ ID NO: 2149) | QQYET SPIT (SEQ ID NO: 2150) | 3 | 37 | 13 |
| ADI-14532 | 92 | VH3-15 | VL1-47 | STGPPY SYFDSS GYSVVDY (SEQ ID NO: 2151) | AAWDD SLSGPV (SEQ ID NO: 2152) | 60 | 19 | 14 |
| ADI-14533 | 93 | VH1-69 | VL1-36 | ARDLQ TGIMSS VRSEY RGFMDP (SEQ ID NO: 2153) | AAWDD SLNGWV (SEQ ID NO: 2154) | 13 | 26 | 10 |
| ADI-14534 | 94 | VH3-30 | VL3-21 | AKSSRL LDWLY NMDF (SEQ ID NO: 2155) | QVWDN SNSQGV (SEQ ID NO: 2156) | 7 | 17 | 10 |
| ADI-14535 | 95 | VH4-304 | VL3-25 | ARGRG YTYGW RYFDY (SEQ ID NO: 2157) | QSSDSS GNVVL (SEQ ID NO: 2158) | 30 | 32 | 9 |
| ADI-14536 | 96 | VH3-30 | VK1-5 | ARDSG TLTGLP | QQYSS YSWT | 20 | 17 | 11 |

TABLE 2-continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| | | | | HDAFDI (SEQ ID NO: 2159) | (SEQ ID NO: 2160) | | | |
| ADI-14537 | 97 | VH3-15 | VL1-47 | STGPPYSYFDSSGYSVVDY (SEQ ID NO: 2161) | AAWDDSLSGPV (SEQ ID NO: 2162) | 60 | 19 | 14 |
| ADI-14538 | 98 | VH3-30 | VL3-21 | AKSSRFLDWLYNMDF (SEQ ID NO: 2163) | QVWDNSHSQGV (SEQ ID NO: 2164) | 7 | 18 | 14 |
| ADI-14539 | 99 | VH3-33 | VK1-5 | ARDSGTLTGLPHDAFDV (SEQ ID NO: 2165) | HHYNSYSWT (SEQ ID NO: 2166) | 20 | 23 | 10 |
| ADI-14540 | 100 | VH3-30 | VK4-1 | ARDGDLVAVPAAIGFDS (SEQ ID NO: 2167) | QQYSSPPYT (SEQ ID NO: 2168) | 11 | 13 | 5 |
| ADI-14541 | 101 | VH3-21 | VL1-40 | ARVIGDGTILGVVFDY (SEQ ID NO: 2169) | QSYDSSLSVI (SEQ ID NO: 2170) | 50 | 26 | 4 |
| ADI-14542 | 102 | VH5-51 | VL6-57 | TIILIPAPIRAPDGFDI (SEQ ID NO: 2171) | QSYDSSYHVV (SEQ ID NO: 2172) | 61 | 10 | 6 |
| ADI-14543 | 103 | VH1-69 | VK1-12 | ARVAGLGNSYGRYPDL (SEQ ID NO: 2173) | QQANSFPYT (SEQ ID NO: 2174) | 49 | 14 | 7 |
| ADI-14544 | 104 | VH5-51 | VL3-21 | ARMLASVGLSNFDA (SEQ ID NO: 2175) | QVWDSISDHVL (SEQ ID NO:2176) | 35 | 14 | 5 |
| ADI-14545 | 105 | VH3-15 | VK1-39 | TSHAYNSDWFVTTDYYYYMDV (SEQ ID NO: 2177) | QQCYSAPIT (SEQ ID NO: 2178) | 64 | 9 | 8 |
| ADI-14546 | 106 | VH1-69 | VK3-20 | ARGISPRTNSDWNHNYFYYYMDV (SEQ ID NO: 2179) | HHYGTSPHT (SEQ ID NO: 2180) | 29 | 22 | 11 |
| ADI-14547 | 107 | VH2-26 | VK2-30 | ARVLTTWHGPDY (SEQ ID NO: 2181) | MQGSHWPHT (SEQ ID NO: 2182) | 51 | 24 | 11 |
| ADI-14548 | 108 | VH3-7 | VL3-21 | ARDVWGWELV | QVWDSSRDHVV | 25 | 11 | 6 |

TABLE 2 -continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| | | | | GWLDP (SEQ ID NO: 2183) | (SEQ ID NO: 2184) | | | |
| ADI-14549 | 109 | VH2-70 | VK1-39 | ARTPIY DSSGY YLYYFDS (SEQ ID NO: 2185) | QQSYST PVT (SEQ ID NO: 2186) | 48 | 7 | 0 |
| ADI-14550 | 110 | VH3-30 | VK4-1 | ARDGDI VAVPA AIGLDY (SEQ ID NO: 2187) | QQYSSP PYT (SEQ ID NO: 2188) | 10 | 13 | 5 |
| ADI-14551 | 111 | VH4-b | VL3-25 | ARGRG YSYGW RFFDN (SEQ ID NO: 2189) | QSGDTS GSYVV (SEQ ID NO: 2190) | 30 | 37 | 9 |
| ADI-14552 | 112 | VH1-69 | VK3-20 | ARSRK NVIGDT SAWEH MYFYMDV (SEQ ID NO: 2191) | QQYGRSMT (SEQ ID NO: 2192) | 45 | 30 | 13 |
| ADI-14553 | 113 | VH1-69 | VK3-20 | ARSNPVA RDFWS GYSDD SSYAMDV (SEQ ID NO: 2193) | QQYGA SAFS (SEQ ID NO: 2194) | 43 | 17 | 16 |
| ADI-14554 | 114 | VH3-15 | VL1-47 | TTGPPY KYFDST GYSVVDY (SEQ ID NO: 2195) | AAWDD RMSGPV (SEQ ID NO: 2196) | 60 | 7 | 4 |
| ADI-14555 | 115 | VH3-23 | VK3-11 | AKAYC SNKAC HGGYFDY (SEQ ID NO: 2197) | HQRSD WPLT | 5 | 16 | 7 |
| ADI-14556 | 116 | VH3-7 | VK3-11 | ARESGL PRGAFQI (SEQ ID NO: 2199) | QHRSDWWT (SEQ ID NO: 2200) | 28 | 12 | 7 |
| ADI-14557 | 117 | VH4-34 | VK3-20 | ARGRK KAPDY (SEQ ID NO: 2201) | QQYGS SPQT (SEQ ID NO: 2202) | 31 | 18 | 5 |
| ADI-14558 | 118 | VH3-23 | VK3-11 | AKAYC SDSCH GGYFDY (SEQ ID NO: 2203) | QQRST WPLT (SEQ ID NO: 2204) | 5 | 14 | 6 |
| ADI-14559 | 119 | VH3-15 | VL1-47 | TTGPPY QYYDS TGYSV VDY (SEQ ID NO: 2205) | AAWDD SLSGPV | 60 | 9 | 14 |
| ADI-14560 | 120 | VH5-51 | VK3-11 | ARQTT MTPDAFDL | QQRSN WGVGT | 41 | 12 | 4 |

TABLE 2 -continued

Germline usage and sequence information of anti-RSV antibodies

| Name | Antibody number (Ab #) | VH germline gene usage | LC germline gene usage | CDR H3 Sequence | CDR L3 Sequence | Lineage number | Number of nucleotide substitutions in VH | Number of nucleotide substitutions in VL |
|---|---|---|---|---|---|---|---|---|
| | | | | (SEQ ID NO: 2207) | (SEQ ID NO: 2208) | | | |
| ADI-14561 | 121 | VH1-69 | VK3-20 | ARSKR LPAGLS TSDYYV (SEQ ID NO: 2209) | HHFGT TPWT (SEQ ID NO: 2210) | 42 | 22 | 15 |
| ADI-14562 | 122 | VH1-69 | VK1-12 | ATVAG LGTSY GRYLES (SEQ ID NO: 2211) | QQAKS FPYT (SEQ ID NO: 2212) | 57 | 29 | 12 |
| ADI-14563 | 123 | VH3-48 | VK3-11 | VRDSR GPTTQ WLTGYFDF (SEQ ID NO: 2213) | QQRRN WPPLT (SEQ ID NO: 2214) | 66 | 21 | 2 |

TABLE 3

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut $IC_{50}$ (µg/ml) subtype A* | Neut $IC_{50}$ (µg/ml) subtype B* |
|---|---|---|---|---|---|---|---|
| ADI-14438 | 1 | 4.35E−09 | 1.18E−08 | 8.92E−09 | 8.29E−09 | 0.289 | 0.237 |
| ADI-14439 | 2 | 2.28E−08 | 5.16E−09 | 2.25E−08 | 1.62E−08 | >10 | 4.122 |
| ADI-14440 | 3 | 1.39E−08 | 1.45E−09 | 8.12E−09 | 2.39E−09 | >10 | 4.180 |
| ADI-14441 | 4 | 8.59E−09 | NB | 8.06E−09 | NB | >10 | 3.920 |
| ADI-14442 | 5 | 4.73E−10 | NB | 7.28E−10 | NB | 0.002 | 0.015 |
| ADI-14443 | 6 | 1.77E−10 | 1.90E−10 | 2.05E−10 | 1.37E−10 | 0.047 | 0.063 |
| ADI-14444 | 7 | NB | NB | 8.33E−08 | NB | >10 | >10 |
| ADI-14445 | 8 | 3.41E−08 | 4.92E−09 | 3.58E−08 | 1.52E−08 | >10 | 1.213 |
| ADI-14446 | 9 | 2.31E−10 | 2.13E−10 | 2.57E−10 | 1.37E−10 | 0.091 | 0.187 |
| ADI-14447 | 10 | 4.37E−10 | 3.39E−10 | 5.46E−10 | 2.71E−10 | 0.143 | 0.372 |
| ADI-14448 | 11 | 3.81E−10 | NB | 5.96E−10 | NB | 0.043 | 0.066 |
| ADI-14449 | 12 | 1.93E−10 | 2.04E−10 | 5.94E−10 | 4.62E−10 | 0.193 | 0.182 |
| ADI-14450 | 13 | 1.76E−10 | 2.27E−10 | 2.29E−10 | 1.42E−10 | 0.195 | 0.315 |
| ADI-14451 | 14 | 3.16E−10 | NB | 4.96E−10 | NB | 0.020 | 0.060 |
| ADI-14452 | 15 | 2.20E−10 | 2.17E−10 | 2.47E−10 | 1.39E−10 | 0.076 | 0.157 |
| ADI-14453 | 16 | 3.94E−10 | 2.61E−10 | 6.70E−10 | 2.28E−10 | >10 | >10 |
| ADI-14454 | 17 | 7.43E−10 | 2.97E−10 | 6.87E−10 | 4.83E−10 | 0.230 | 2.537 |
| ADI-14455 | 18 | 2.14E−09 | NB | 4.40E−09 | NB | 0.012 | 0.036 |
| ADI-14456 | 19 | 6.03E−09 | NB | 3.91E−09 | NB | >10 | 0.372 |
| ADI-14457 | 20 | 4.66E−10 | 3.80E−10 | 2.03E−09 | 4.61E−10 | 0.200 | 0.251 |

TABLE 3-continued

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut $IC_{50}$ (µg/ml) subtype A* | Neut $IC_{50}$ (µg/ml) subtype B* |
|---|---|---|---|---|---|---|---|
| ADI-14458 | 21 | 1.39E−10 | 1.96E−10 | 1.84E−10 | 1.26E−10 | 0.161 | 0.104 |
| ADI-14459 | 22 | 2.30E−10 | 2.64E−10 | 3.04E−10 | 1.83E−10 | 0.396 | 0.753 |
| ADI-14460 | 23 | 2.69E−10 | 2.86E−09 | 1.09E−09 | 2.56E−09 | 0.102 | 0.239 |
| ADI-14461 | 24 | 1.90E−10 | 2.31E−10 | 2.44E−10 | 1.56E−10 | 0.129 | 0.152 |
| ADI-14462 | 25 | 1.12E−08 | NB | 1.68E−08 | NB | 2.706 | 2.631 |
| ADI-14463 | 26 | 4.25E−10 | NB | 1.86E−09 | NB | 0.009 | 0.036 |
| ADI-14464 | 27 | 3.22E−09 | NB | 3.11E−09 | NB | >10 | 0.161 |
| ADI-14465 | 28 | 1.22E−09 | NB | 2.74E−09 | NB | 0.431 | 0.124 |
| ADI-14466 | 29 | 3.48E−10 | 2.47E−10 | 3.98E−10 | 1.69E−10 | 0.144 | 0.263 |
| ADI-14467 | 30 | 4.90E−10 | NB | 2.44E−09 | NB | 0.060 | 0.065 |
| ADI-14468 | 31 | 1.51E−09 | 2.97E−10 | 5.52E−10 | 2.41E−10 | 0.241 | 2.412 |
| ADI-14469 | 32 | 3.82E−10 | 3.01E−10 | 2.37E−09 | 2.90E−09 | 0.050 | 0.013 |
| ADI-14470 | 33 | 5.42E−10 | 3.58E−10 | 5.49E−10 | 3.14E−10 | 0.226 | 0.473 |
| ADI-14471 | 34 | 1.69E−10 | 2.12E−10 | 2.17E−10 | 1.50E−10 | 0.096 | 0.116 |
| ADI-14473 | 35 | 1.55E−09 | 2.24E−10 | 8.91E−10 | 1.51E−10 | | |
| ADI-14474 | 36 | 4.43E−10 | NB | 8.77E−10 | NB | 0.019 | 0.016 |
| ADI-14475 | 37 | 3.36E−10 | 2.99E−10 | 5.32E−10 | 2.42E−10 | 0.391 | 0.522 |
| ADI-14476 | 38 | 1.95E−09 | 8.27E−10 | 1.14E−08 | 9.12E−09 | 0.929 | 2.186 |
| ADI-14477 | 39 | 1.36E−09 | 3.61E−10 | 8.78E−10 | 1.22E−09 | >10 | >10 |
| ADI-14478 | 40 | 1.60E−09 | NB | 3.05E−09 | NB | 0.163 | 0.057 |
| ADI-14479 | 41 | 3.95E−08 | NB | NB | NB | 4.090 | 22.680 |
| ADI-14480 | 42 | 6.43E−09 | NB | 7.57E−09 | NB | >10 | 2.759 |
| ADI-14482 | 43 | 1.26E−10 | NB | 2.39E−10 | NB | 0.024 | 0.031 |
| ADI-14483 | 44 | 2.67E−10 | NB | 4.85E−10 | 2.00E−08 | 0.031 | 0.030 |
| ADI-14484 | 45 | 4.65E−10 | 3.89E−10 | 2.18E−09 | 3.94E−10 | 0.448 | 0.169 |
| ADI-14485 | 46 | 6.45E−09 | 1.52E−09 | 7.52E−09 | 6.42E−10 | >10 | 2.813 |
| ADI-14486 | 47 | 2.61E−09 | 5.29E−10 | 1.78E−09 | 6.36E−10 | | |
| ADI-14487 | 48 | 8.04E−08 | NB | NB | NB | >10 | >10 |
| ADI-14488 | 49 | NB | 1.48E−08 | NB | NB | >10 | >10 |
| ADI-14489 | 50 | 3.82E−10 | NB | 6.78E−10 | NB | 0.023 | 0.021 |
| ADI-14490 | 51 | 9.07E−09 | NB | 2.62E−08 | NB | 1.016 | 0.113 |
| ADI-14491 | 52 | 1.83E−10 | 2.38E−10 | 2.37E−10 | 1.58E−10 | 0.105 | 0.102 |
| ADI-14492 | 53 | 1.24E−10 | 1.66E−10 | 1.76E−10 | 1.11E−10 | 0.204 | 0.681 |
| ADI-14493 | 54 | 9.76E−10 | NB | 3.02E−09 | NB | 0.009 | 1.272 |
| ADI-14494 | 55 | 1.75E−10 | 2.40E−10 | 2.32E−10 | 1.55E−10 | 0.084 | 0.089 |
| ADI-14495 | 56 | 1.15E−09 | 3.67E−10 | 1.24E−09 | 1.71E−09 | 0.864 | 17.440 |

TABLE 3-continued

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut $IC_{50}$ (μg/ml) subtype A* | Neut $IC_{50}$ (μg/ml) subtype B* |
|---|---|---|---|---|---|---|---|
| ADI-14496 | 57 | 1.88E−10 | NB | 6.71E−09 | NB | 0.006 | >10 |
| ADI-14497 | 58 | 3.49E−10 | 3.58E−10 | 4.57E−09 | 4.82E−09 | 0.115 | 0.116 |
| ADI-14498 | 59 | 5.67E−10 | 4.12E−10 | 1.05E−09 | 2.27E−09 | >10 | >10 |
| ADI-14499 | 60 | 1.71E−09 | 4.15E−10 | 3.80E−09 | 2.99E−09 | >10 | >10 |
| ADI-14500 | 61 | 6.38E−10 | 7.14E−10 | 9.10E−10 | 1.27E−10 | 0.415 | 0.552 |
| ADI-14501 | 62 | 1.59E−08 | NB | 3.47E−08 | NB | 12.350 | 2.288 |
| ADI-14502 | 63 | 5.00E−09 | NB | 1.10E−08 | NB | >10 | 2.718 |
| ADI-14503 | 64 | 1.12E−10 | 2.61E−08 | 7.76E−10 |  | 0.016 | 0.026 |
| ADI-14504 | 65 | 4.54E−09 | 5.83E−10 | 1.12E−09 | 5.20E−10 | 2.810 | 13.390 |
| ADI-14505 | 66 | 1.56E−10 | NB | 2.90E−10 | NB | 0.065 | 0.018 |
| ADI-14506 | 67 | 5.91E−08 | 1.31E−08 | 5.02E−08 | 2.45E−08 | >10 | 6.250 |
| ADI-14507 | 68 | 3.13E−10 | 2.66E−10 | 4.69E−10 | 4.13E−10 | 0.319 | 0.173 |
| ADI-14508 | 69 | 3.27E−10 | NB | 5.77E−10 | NB | 0.029 | 0.057 |
| ADI-14509 | 70 | 3.64E−10 | NB | 6.15E−10 | NB | 0.011 | 0.016 |
| ADI-14510 | 71 | 4.13E−09 | 7.83E−10 | 1.96E−09 | 6.19E−10 | >10 | >10 |
| ADI-14511 | 72 | 4.14E−09 | 9.88E−10 | 2.60E−09 | 1.25E−09 | >10 | 7.037 |
| ADI-14512 | 73 | 1.67E−08 | 2.67E−09 | 2.13E−09 | 5.87E−10 | >10 | >10 |
| ADI-14513 | 74 | 3.86E−09 | 1.21E−09 | 4.42E−09 | 9.62E−10 | 4.807 | 2.201 |
| ADI-14514 | 75 | 3.83E−10 | NB | 6.82E−10 | NB | 0.046 | 0.074 |
| ADI-14515 | 76 | 5.21E−10 | NB | 1.10E−09 | NB | 0.051 | 0.049 |
| ADI-14516 | 77 | 3.36E−10 | NB | 6.02E−10 | NB | 0.018 | 0.047 |
| ADI-14518 | 78 | 2.83E−10 | NB | 4.97E−10 | NB | 0.019 | 0.032 |
| ADI-14519 | 79 | 3.76E−09 | NB | 3.85E−09 | NB | 12.230 | 3.426 |
| ADI-14520 | 80 | 1.26E−10 | NB | 2.40E−10 | NB | 0.029 | 0.045 |
| ADI-14521 | 81 | 4.61E−10 | NB | 9.27E−10 | NB | 0.083 | 0.123 |
| ADI-14522 | 82 | NB | 1.49E−09 | NB | 1.06E−09 | 3.528 | 7.285 |
| ADI-14523 | 83 | 1.36E−10 | 1.92E−10 | 1.98E−10 | 1.31E−10 | 0.239 | 0.151 |
| ADI-14524 | 84 | NB | 8.26E−10 | NB | 7.71E−10 | 6.046 | 6.000 |
| ADI-14525 | 85 | 1.79E−10 | 2.30E−10 | 2.32E−10 | 1.49E−10 | 0.135 | 0.108 |
| ADI-14526 | 86 | 2.57E−09 | 3.46E−10 | 1.67E−09 | 3.42E−10 | 2.361 | 9.672 |
| ADI-14527 | 87 | 4.65E−09 | 8.89E−10 | 2.84E−09 | 6.45E−10 | >10 | >10 |
| ADI-14528 | 88 | 1.60E−07 | 3.52E−08 | 9.07E−08 |  | >10 | 0.705 |
| ADI-14529 | 89 | 1.16E−09 | 1.71E−09 | 1.21E−09 | 7.98E−10 | 2.382 | 0.991 |
| ADI-14530 | 90 | 1.90E−07 | 4.72E−08 | 8.83E−08 | 3.76E−08 | >10 | >10 |
| ADI-14531 | 91 | 6.64E−08 | 1.26E−08 | 5.37E−08 | 2.38E−08 | >10 | >10 |

TABLE 3-continued

Affinity and Neutralization data for anti-RSV antibodies

| Name | Antibody number (Ab #) | Prefusion subtype A $K_D$ (M)* | Postfusion subtype A $K_D$ (M)* | Prefusion subtype B $K_D$ (M)* | Postfusion subtype B $K_D$ (M)* | Neut IC$_{50}$ (µg/ml) subtype A* | Neut IC$_{50}$ (µg/ml) subtype B* |
|---|---|---|---|---|---|---|---|
| ADI-14532 | 92 | 1.48E−10 | 2.24E−10 | 2.10E−10 | 1.36E−10 | 0.168 | 0.208 |
| ADI-14533 | 93 | 5.38E−09 | NB | 2.31E−09 | NB | >10 | 0.442 |
| ADI-14534 | 94 | 1.63E−08 | 1.00E−09 | 5.05E−09 | 9.30E−10 | >10 | >10 |
| ADI-14535 | 95 | 3.21E−09 | 2.30E−10 | 1.81E−09 | 2.38E−10 | >10 | >10 |
| ADI-14536 | 96 | 6.20E−10 | 4.04E−10 | 8.49E−10 | 3.82E−10 | 0.560 | 0.696 |
| ADI-14537 | 97 | 3.00E−10 | 2.11E−10 | 2.93E−10 | 1.42E−10 | 0.272 | 0.292 |
| ADI-14538 | 98 | 4.41E−09 | 3.50E−10 | 2.12E−09 | 1.54E−10 | >10 | >10 |
| ADI-14539 | 99 | 2.16E−09 | 7.38E−10 | 5.09E−09 | 5.71E−09 | 0.727 | 0.302 |
| ADI-14540 | 100 | 9.23E−09 | NB | 2.31E−09 | NB | >10 | >10 |
| ADI-14541 | 101 | 3.23E−10 | NB | 5.32E−10 | NB | 0.023 | 0.106 |
| ADI-14542 | 102 | 2.78E−09 | NB | 2.64E−08 | NB | 0.008 | 4.299 |
| ADI-14543 | 103 | NB | NB | NB | NB | >10 | >10 |
| ADI-14544 | 104 | 4.28E−10 | NB | 2.24E−08 | NB | >10 | >10 |
| ADI-14545 | 105 | 1.43E−09 | NB | 3.63E−09 | NB | 0.036 | 0.073 |
| ADI-14546 | 106 | 3.74E−09 | 5.89E−10 | 1.83E−09 | 4.72E−10 | >10 | >10 |
| ADI-14547 | 107 | 2.11E−10 | 1.69E−10 | 2.82E−10 | 2.69E−10 | 0.198 | 0.252 |
| ADI-14548 | 108 | 3.31E−10 | NB | 5.02E−10 | NB | 0.034 | 0.094 |
| ADI-14549 | 109 | 2.70E−09 | 3.26E−10 | 3.29E−09 | 2.49E−09 | >10 | >10 |
| ADI-14550 | 110 | 1.04E−08 | NB | 3.60E−09 | NB | 2.615 | >10 |
| ADI-14551 | 111 | 1.56E−09 | 2.07E−10 | 1.15E−09 | 1.95E−10 | | |
| ADI-14552 | 112 | 9.99E−09 | 1.27E−09 | 3.62E−09 | 1.11E−09 | >10 | >10 |
| ADI-14553 | 113 | NB | 6.71E−08 | NB | 1.17E−07 | >10 | >10 |
| ADI-14554 | 114 | | 3.88E−10 | 3.90E−10 | 1.97E−10 | 0.736 | 0.787 |
| ADI-14555 | 115 | NB | NB | 1.58E−08 | NB | >10 | >10 |
| ADI-14556 | 116 | NB | NB | | NB | >10 | >10 |
| ADI-14557 | 117 | 3.14E−08 | NB | NB | NB | >10 | >10 |
| ADI-14558 | 118 | NB | NB | 2.91E−08 | NB | >10 | >10 |
| ADI-14559 | 119 | 5.38E−10 | 2.04E−10 | 3.69E−10 | 1.29E−10 | 0.057 | 0.031 |
| ADI-14560 | 120 | NB | 8.74E−10 | 1.14E−08 | 3.29E−10 | >10 | >10 |
| ADI-14561 | 121 | 1.50E−08 | 3.09E−09 | 7.94E−09 | 2.28E−09 | >10 | >10 |
| ADI-14562 | 122 | 4.53E−09 | NB | 1.39E−08 | NB | >10 | 10.470 |
| ADI-14563 | 123 | NB | NB | | NB | >10 | >10 |

*NN; non-neutralizing, NB; non-binding, ND; not determined. IgG KDs were calculated for antibodies with BLI binding responses >0.1 nm. Antibodies with BLI binding responses <0.05 nm were designated as NB.

TABLE 4

Bin, patch, and antigenic site assignments for anti-RSV antibodies

| Name | Antibody number (Ab #) | Bin Assignment | Patch Assignment | Antigenic Site Assignment |
|---|---|---|---|---|
| ADI-14438 | 1 | Mota | | |
| ADI-14439 | 2 | Unknown | | |
| ADI-14440 | 3 | Unknown | | |
| ADI-14441 | 4 | MPE8 | | |
| ADI-14442 | 5 | Mota/MPE8 | 4, 2 | V |
| ADI-14443 | 6 | 14443 | 9 | IV |
| ADI-14444 | 7 | D25 | | |
| ADI-14445 | 8 | Unknown | | |
| ADI-14446 | 9 | 14443 | 9 | IV |
| ADI-14447 | 10 | Mota | 5 | II |
| ADI-14448 | 11 | Mota/MPE8 | | III |
| ADI-14449 | 12 | 14443 | 9 | IV |
| ADI-14450 | 13 | 14443 | 9 | IV |
| ADI-14451 | 14 | MPE8 | 4 | V |
| ADI-14452 | 15 | 14443 | 9 | IV |
| ADI-14453 | 16 | 14469 | 8 | I |
| ADI-14454 | 17 | 14469 | 8 | I |
| ADI-14455 | 18 | D25/mota/MPE8 | | |
| ADI-14456 | 19 | 101F | | |
| ADI-14457 | 20 | 14469 | 8 | I |
| ADI-14458 | 21 | 14443 | 9 | IV |
| ADI-14459 | 22 | 14443 | 9 | IV |
| ADI-14460 | 23 | 14443 | 9 | IV |
| ADI-14461 | 24 | 14443 | 9 | IV |
| ADI-14462 | 25 | 101F | | |
| ADI-14463 | 26 | D25/mota/MPE8 | 4 | V |
| ADI-14464 | 27 | 101F | | |
| ADI-14465 | 28 | 101F | 9 | IV |
| ADI-14466 | 29 | Mota | 5 | II |
| ADI-14467 | 30 | D25/mota/MPE8 | 4, 2 | V |
| ADI-14468 | 31 | 14469 | | I |
| ADI-14469 | 32 | 14469 | 8 | I |
| ADI-14470 | 33 | 14469 | | I |
| ADI-14471 | 34 | 14443 | 9 | IV |
| ADI-14473 | 35 | Mota | 5 | II |
| ADI-14474 | 36 | D25/mota/MPE8 | 4, 2 | V |
| ADI-14475 | 37 | 14469 | 8 | I |
| ADI-14476 | 38 | 13390 | | I |
| ADI-14477 | 39 | 13390 | 8 | I |
| ADI-14478 | 40 | Mota/MPE8 | | III |
| ADI-14479 | 41 | Mota | | |
| ADI-14480 | 42 | MPE8 | | |
| ADI-14482 | 43 | 14443 | 9 | IV |
| ADI-14483 | 44 | Mota/MPE8 | | III |
| ADI-14484 | 45 | 14469 | 8 | I |
| ADI-14485 | 46 | Unknown | | |
| ADI-14486 | 47 | 101F | | |
| ADI-14487 | 48 | Mota | | |
| ADI-14488 | 49 | Unknown | | |
| ADI-14489 | 50 | Mota/MPE8 | 4, 2 | V |
| ADI-14490 | 51 | D25/mota/MPE8 | | |
| ADI-14491 | 52 | 14443 | 9 | IV |
| ADI-14492 | 53 | 14443 | 9 | IV |
| ADI-14493 | 54 | 14443 | 9 | IV |
| ADI-14494 | 55 | 14443 | 9 | IV |
| ADI-14495 | 56 | Unknown | | I |
| ADI-14496 | 57 | D25 | 1 | Ø |
| ADI-14497 | 58 | 14469 | 8 | I |
| ADI-14498 | 59 | 14469 | 8 | I |
| ADI-14499 | 60 | 13390 | 8 | I |
| ADI-14500 | 61 | 14443 | 9 | IV |
| ADI-14501 | 62 | MPE8 | | |
| ADI-14502 | 63 | AM14 | | |
| ADI-14503 | 64 | 14443 | 9 | IV |
| ADI-14504 | 65 | Mota | | |
| ADI-14505 | 66 | 14443 | 9 | IV |
| ADI-14506 | 67 | Unknown | | |
| ADI-14507 | 68 | 14469 | | I |
| ADI-14508 | 69 | MPE8 | 4 | V |
| ADI-14509 | 70 | Mota/MPE8 | 4 | V |
| ADI-14510 | 71 | Unknown | | |
| ADI-14511 | 72 | Unknown | | |
| ADI-14512 | 73 | Unknown | | |
| ADI-14513 | 74 | Unknown | | |
| ADI-14514 | 75 | Mota/MPE8 | 4 | V |
| ADI-14515 | 76 | Mota/MPE8 | | V |
| ADI-14516 | 77 | D25/mota/MPE8 | 4 | V |
| ADI-14518 | 78 | Mota/MPE8 | 4 | V |
| ADI-14519 | 79 | 101F | | |
| ADI-14520 | 80 | 14443 | 9 | IV |
| ADI-14521 | 81 | D25/mota/MPE8 | 4 | V |
| ADI-14522 | 82 | Unknown | | |
| ADI-14523 | 83 | 14443 | 9 | IV |
| ADI-14524 | 84 | Unknown | | |
| ADI-14525 | 85 | 14443 | 9 | IV |
| ADI-14526 | 86 | Unknown | | |
| ADI-14527 | 87 | Unknown | | |
| ADI-14528 | 88 | Unknown | | |
| ADI-14529 | 89 | 101F | 9 | IV |
| ADI-14530 | 90 | Unknown | | |
| ADI-14531 | 91 | Unknown | | |
| ADI-14532 | 92 | 14443 | 9 | IV |
| ADI-14533 | 93 | Unknown | | |
| ADI-14534 | 94 | Unknown | | |
| ADI-14535 | 95 | Unknown | | |
| ADI-14536 | 96 | Mota | 5 | II |
| ADI-14537 | 97 | 14443 | 9 | IV |
| ADI-14538 | 98 | Mota | | |
| ADI-14539 | 99 | Mota | | |
| ADI-14540 | 100 | Unknown | | |
| ADI-14541 | 101 | MPE8 | | III |
| ADI-14542 | 102 | D25 | | |
| ADI-14543 | 103 | Unknown | | |
| ADI-14544 | 104 | D25 | 1 | Ø |
| ADI-14545 | 105 | D25 | 1, 2 | Ø |
| ADI-14546 | 106 | Unknown | | |
| ADI-14547 | 107 | 14443 | 9 | IV |
| ADI-14548 | 108 | 14443 | 9 | IV |
| ADI-14549 | 109 | 13390 | | |
| ADI-14550 | 110 | Unknown | | |
| ADI-14551 | 111 | Unknown | 1 | UK |
| ADI-14552 | 112 | Unknown | | |
| ADI-14553 | 113 | Unknown | | |
| ADI-14554 | 114 | 14443 | | |
| ADI-14555 | 115 | Unknown | | |
| ADI-14556 | 116 | Unknown | | |
| ADI-14557 | 117 | 101F | | |
| ADI-14558 | 118 | Unknown | | |
| ADI-14559 | 119 | 14443 | 9 | IV |
| ADI-14560 | 120 | Mota | | |
| ADI-14561 | 121 | Unknown | | |
| ADI-14562 | 122 | AM14 | | |
| ADI-14563 | 123 | Unknown | | |

TABLE 5

A subset of anti-RSV F antibodies cross-neutralize human metapneumovirus.

| Name | Antibody number (Ab #) | HMPV-A1 $IC_{50}$ (μg/ml) | RSV-A2 $IC_{50}$ (μg/ml) | Prefusion RSV F $K_D$ (M) | Postfusion RSV F $K_D$ (M) | RSV F Binding Site |
|---|---|---|---|---|---|---|
| ADI-14448 | 11 | 0.05 | 0.04 | $3.8 \times 10^{-10}$ | N.B. | III |
| ADI-14441 | 4 | 37.8 | >25 | $8.6 \times 10^{-9}$ | N.B. | III* |
| ADI-14501 | 62 | 31.4 | 12.4 | $1.6 \times 10^{-8}$ | N.B. | III* |
| MPE8 Control | N/A | 0.07 | 0.04 | — | — | — |

N.B., non-binder;
N/A, not applicable
*Binding site assignment based on competition only.

Materials and Methods

Study Design

To profile the antibody response to RSV F, peripheral blood mononuclear cells were obtained from an adult donor approximately between 20-35 years of age, and monoclonal antibodies from RSV F-reactive B cells were isolated therefrom. The antibodies were characterized by sequencing, binding, epitope mapping, and neutralization assays. All samples for this study were collected with informed consent of volunteers. This study was unblinded and not randomized. At least two independent experiments were performed for each assay.

Generation of RSV F Sorting Probes

The soluble prefusion and postfusion probes were based on the RSV F ΔFP and DS-Cav1 constructs that we previously crystallized and determined to be in the pre- and postfusion conformations, respectively (11, 15). To increase the avidity of the probes and to uniformly orient the RSV F proteins, the trimeric RSV F proteins were coupled to tetrameric streptavidin through biotinylation of a C-terminal AviTag. For each probe, both a C-terminal His-Avi tagged version and a C-terminal StrepTagII version were co-transfected into FreeStyle 293-F cells. The secreted proteins were purified first over Ni-NTA resin to remove trimers lacking the His-Avi tag. The elution from the Ni-NTA purification was then purified over Strep-Tactin resin. Due to the low avidity of a single StrepTagII for the Strep-Tactin resin, additional washing steps were able to remove singly StrepTagged trimers. This resulted in the purification of trimers containing two StrepTagII tagged monomers and therefore only one His-Avi tagged monomer. This purification scheme results in a single AviTag per trimer which greatly reduces the aggregation or 'daisy-chaining' that occurs when trimeric proteins containing three AviTags are incubated with tetrameric streptavidin. RSV F trimers were biotinylated using biotin ligase BirA according to the manufacturer's instructions (Avidity, LLC). Biotinylated proteins were separated from excess biotin by size-exclusion chromatography on a Superdex 200 column (GE Healthcare). Quantification of the number of biotin moieties per RSV F trimer was performed using the Quant*Tag Biotin Kit per the manufacturer's instructions (Vector Laboratories).

Single B-Cell Sorting

Peripheral blood mononuclear cells were stained using anti-human IgG (BV605), IgA (FITC), CD27 (BV421), CD8 (PerCP-Cy5.5), CD14 (PerCP-Cy5.5), CD19 (PECy7), CD20 (PECy7) and a mixture of dual-labeled DS-Cav1 and F ΔFP tetramers (50 nM each). Dual-labeled RSV F tetramers were generated by incubating the individual AviTagged RSV F proteins with premium-grade phycoerythrin-labeled streptavidin (Molecular Probes) or premium-grade allophycocyanin-labeled streptavidin for at least 20 minutes on ice at a molar ratio of 4:1. Tetramers were prepared fresh for each experiment. Single cells were sorted on a BD fluorescence-activated cell sorter Aria II into 96-well PCR plates (BioRad) containing 20 μL/well of lysis buffer [5 μL of 5× first strand cDNA buffer (Invitrogen), 0.25 μL RNaseOUT (Invitrogen), 1.25 μL dithiothreitol (Invitrogen), 0.625 μL NP-40 (New England Biolabs), and 12.6 μL $dH_2O$]. Plates were immediately frozen on dry ice before storage at −80° C.

Amplification and Cloning of Antibody Variable Genes

Single B cell PCR was performed as described previously (22). Briefly, IgH, Igλ and Igκ variable genes were amplified by RT-PCR and nested PCR reactions using cocktails of IgG and IgA-specific primers (22). The primers used in the second round of PCR contained 40 base pairs of 5' and 3' homology to the cut expression vectors to allow for cloning by homologous recombination into Saccharomyces cerevisiae (40). PCR products were cloned into S. cerevisiae using the lithium acetate method for chemical transformation (41). Each transformation reaction contained 20 μL of unpurified heavy chain and light chain PCR product and 200 ng of cut heavy and light chain plasmids. Following transformation, individual yeast colonies were picked for sequencing and characterization.

Expression and Purification of IgGs and Fab Fragments

Anti-RSV F IgGs were expressed in S. cerevisiae cultures grown in 24-well plates, as described previously (23). Fab fragments used for competition assays were generated by digesting the IgGs with papain for 2 hours at 30° C. The digestion was terminated by the addition of iodoacetamide, and the Fab and Fc mixtures were passed over Protein A agarose to remove Fc fragments and undigested IgG. The flowthrough of the Protein A resin was then passed over CaptureSelect™ IgG-CH1 affinity resin (ThermoFischer Scientific), and eluted with 200 mM acetic acid/50 mM NaCl pH 3.5 into ⅛th volume 2M Hepes pH 8.0. Fab fragments then were buffer-exchanged into PBS pH 7.0.

Biolayer Interferometry Binding Analysis

IgG binding to DS-Cav1 and FA FP was determined by BLI measurements using a FortéBio Octet HTX instrument (Pall Life Sciences). For high-throughput $K_D$ screening, IgGs were immobilized on AHQ sensors (Pall Life Sciences) and exposed to 100 nM antigen in PBS containing 0.1% BSA (PBSF) for an association step, followed by a dissociation step in PBSF buffer. Data was analyzed using the FortéBio Data Analysis Software 7. The data was fit to a 1:1 binding model to calculate an association and dissociation rate, and $K_D$ was calculated using the ratio $k_d/k_a$.

Antibody Competition Assays

Antibody competition assays were performed as previously described (23). Antibody competition was measured by the ability of a control anti-RSV F Fab to inhibit binding of yeast surface-expressed anti-RSV F IgGs to either DS-Cav1 or FA FP. 50 nM biotinylated DS-Cav1 or FA FP was pre-incubated with 1 µM competitor Fab for 30 min at room temperature and then added to a suspension of yeast expressing anti-RSV F IgG. Unbound antigen was removed by washing with PBS containing 0.1% BSA (PBSF). After washing, bound antigen was detected using streptavidin Alexa Fluor 633 at a 1:500 dilution (Life Technologies) and analyzed by flow cytometry using a FACSCanto II (BD Biosciences). The level of competition was assessed by measuring the fold reduction in antigen binding in the presence of competitor Fab relative to an antigen-only control. Antibodies were considered competitors when a greater than five-fold reduction was observed in the presence of control Fab relative to an antigen-only control.

Expression, Purification and Biotinylation of preF Patch Variants

A panel of 9 patches of 2-4 mutations uniformly covering the surface of the preF molecule was designed based on the structure of prefusion RSV F (10). For known antigenic sites, including those recognized by motavizumab, 101F, D25, AM14 and MPE8, patches incorporated residues associated with viral escape or known to be critical for antibody binding. Residues with high conservation across 184 subtype A, subtype B and bovine RSV F sequences were avoided where possible to minimize the likelihood of disrupting protein structure. The mutations present in each patch variant are shown in FIG. 7A. Mutations for each patch variant were cloned into the prefusion stabilized RSV F (DS-Cav1) construct with a C-terminal AviTag for site specific biotinylation. Proteins were secreted from FreeStyle 293-F cells, purified over Ni-NTA resin and biotinylated using biotin ligase BirA according to the manufacturer's instructions (Avidity, LLC). Biotinylated proteins were separated from excess biotin by size-exclusion chromatography on a Superdex 200 column (GE Healthcare). A deglycosylated version of DS-Cav1 was produced by expressing DS-Cav1 in the presence of 1 µM kifunensine and digesting with 10% (wt/wt) EndoH before biotinylation.

Luminex Assay for Patch Variant Binding

Binding of isolated antibodies to the patch variants was determined using a high-throughput Luminex assay. Each biotinylated variant and a DS-Cav1 control were coupled to avidin coated MagPlex beads (Bio-Rad), each with a bead identification number reflecting a unique ratio of red and infrared dyes embedded within the bead. The coupled beads were then mixed with a six-fold serial dilution of each antibody, ranging from 400 nM to 1.4 pM, in a 384-well plate. Beads were washed using a magnetic microplate washer (BioTek) before incubation with a PE conjugated mouse anti-human IgG Fc secondary antibody (Southern Biotech). Beads were classified and binding of PE was measured using a FLEXMAP 3D flow cytometer (Luminex).

RSV Neutralization Assays

Viral stocks were prepared and maintained as previously described (61). Recombinant mKate-RSV expressing prototypic subtype A (strain A2) and subtype B (18537) F genes and the Katushka fluorescent protein were constructed as reported by Hotard et al. (62). HEp-2 cells were maintained in Eagle's minimal essential medium containing 10% fetal bovine serum supplemented with glutamine, penicillin and streptomycin. Antibody neutralization was measured by a fluorescence plate reader neutralization assay (15). A 30 µL solution of culture media containing $2.4 \times 10^4$ HEp-2 cells was seeded in 384-well black optical bottom plate (Nunc, Thermo Scientific). IgG samples were serially diluted four-fold from 1:10 to 1:163840 and an equal volume of recombinant mKate-RSV A2 was added. Samples were mixed and incubated at 37° C. for one hour. After incubation, 50 µL mixture of sample and virus was added to cells in 384-well plate, and incubated at 37° C. for 22-24 hours. The assay plate was then measured for fluorescence intensity in a microplate reader at Ex 588 nm and Em 635 nm (SpectraMax Paradigm, molecular devices). $IC_{50}$ of neutralization for each sample was calculated by curve fitting using Prism (GraphPad Software Inc.).

Human Metapneumovirus Neutralization Assays

Predetermined amounts of GFP-expressing hMPV recombinant virus (NL/1/00, A1 sublineage, a kind gift of Bernadette van den Hoogen and Ron Fouchier, Rotterdam, the Netherlands) were mixed with serial dilutions of monoclonal antibodies before being added to cultures of Vero-118 cells growing in 96-well plates with Dulbecco's Modified Eagle's medium supplemented with 10% fetal calf serum. Thirty-six hours later, the medium was removed, PBS was added and the amount of GFP per well was measured with a Tecan microplate reader M200. Fluorescence values were represented as percent of a virus control without antibody.

Polyreactivity Assay

Antibody polyreactivity was assessed using a previously described high-throughput assay that measures binding to solubilized CHO cell membrane preparations (SMPs) (43). Briefly, two million IgG-presenting yeast were transferred into a 96-well assay plate and pelleted to remove the supernatant. The pellet was resuspended in 50 µL of 1:10 diluted stock b-SMPs and incubated on ice for 20 minutes. Cells were then washed twice with ice-cold PBSF and the cell pellet was re-suspended in 50 µL of secondary labeling mix (Extravidin-R-PE, anti-human LCFITC, and propidium iodide). The mix was incubated on ice for 20 minutes followed by two washes with ice-cold PBSF. Cells were then re-suspended in 100 µL of ice-cold PBSF, and the plate was run on a FACSCanto II (BD Biosciences) using a HTS sample injector. Flow cytometry data was analyzed for mean fluorescence intensity in the R-PE channel and normalized to proper controls in order to assess non-specific binding.

REFERENCES AND NOTES

1. A. L. Rogovik, B. Carleton, A. Solimano, R. D. Goldman, Palivizumab for the prevention of respiratory syncytial virus infection. *Can Fam Physician* 56, 769-772 (2010).
2. B. S. Graham, Biological challenges and technological opportunities for respiratory syncytial virus vaccine development. *Immunol Rev* 239, 149-166 (2011).
3. J. R. Groothuis, E. A. Simoes, V. G. Hemming, Respiratory syncytial virus (RSV) infection in preterm infants and the protective effects of RSV immune globulin (RSVIG). Respiratory Syncytial Virus Immune Globulin Study Group. *Pediatrics* 95, 463-467 (1995).
4. M. Magro, V. Mas, K. Chappell, M. Vazquez, O. Cano, D. Luque, M. C. Terron, J. A. Melero, C. Palomo, Neutralizing antibodies against the preactive form of respiratory syncytial virus fusion protein offer unique possibilities for clinical intervention. *Proc Natl Acad Sci USA* 109, 3089-3094 (2012).
5. S. Johnson, C. Oliver, G. A. Prince, V. G. Hemming, D. S. Pfarr, S. C. Wang, M. Dormitzer, J. O'Grady, S.

Koenig, J. K. Tamura, R. Woods, G. Bansal, D. Couchenour, E. Tsao, W. C. Hall, J. F. Young, Development of a humanized monoclonal antibody (MEDI-493) with potent in vitro and in vivo activity against respiratory syncytial virus. *J Infect Dis* 176, 1215-1224 (1997).
6. J. A. Beeler, K. van Wyke Coelingh, Neutralization epitopes of the F glycoprotein of respiratory syncytial virus: effect of mutation upon fusion function. *J Virol* 63, 2941-2950 (1989).
7. R. A. Karron, D. A. Buonagurio, A. F. Georgiu, S. S. Whitehead, J. E. Adamus, M. L. Clements-Mann, D. O. Harris, V. B. Randolph, S. A. Udem, B. R. Murphy, M. S. Sidhu, Respiratory syncytial virus (RSV) SH and G proteins are not essential for viral replication in vitro: clinical evaluation and molecular characterization of a cold-passaged, attenuated RSV subgroup B mutant. *Proc Natl Acad Sci USA* 94, 13961-13966 (1997).
8. J. O. Ngwuta, M. Chen, K. Modjarrad, M. G. Joyce, M. Kanekiyo, A. Kumar, H. M. Yassine, S. M. Moin, A. M. Killikelly, G. Y. Chuang, A. Druz, I. S. Georgiev, E. J. Rundlet, M. Sastry, G. B. Stewart-Jones, Y. Yang, B. Zhang, M. C. Nason, C. Capella, M. E. Peeples, J. E. Ledgerwood, J. S. McLellan, P. D. Kwong, B. S. Graham, Prefusion F-specific antibodies determine the magnitude of RSV neutralizing activity in human sera. *Sci Transl Med* 7, 309ra162 (2015).
9. T. I.-R. S. Group, Palivizumab, a humanized respiratory syncytial virus monoclonal antibody, reduces hospitalization from respiratory syncytial virus infection in high-risk infants. *Pediatrics* 102, 531-537 (1998).
10. J. S. McLellan, M. Chen, S. Leung, K. W. Graepel, X. Du, Y. Yang, T. Zhou, U. Baxa, E. Yasuda, T. Beaumont, A. Kumar, K. Modjarrad, Z. Zheng, M. Zhao, N. Xia, P. D. Kwong, B. S. Graham, Structure of RSV fusion glycoprotein trimer bound to a prefusion-specific neutralizing antibody. *Science* 340, 1113-1117 (2013).
11. J. S. McLellan, Y. Yang, B. S. Graham, P. D. Kwong, Structure of respiratory syncytial virus fusion glycoprotein in the postfusion conformation reveals preservation of neutralizing epitopes. *J Virol* 85, 7788-7796 (2011).
12. K. A. Swanson, E. C. Settembre, C. A. Shaw, A. K. Dey, R. Rappuoli, C. W. Mandl, P. R. Dormitzer, A. Carfi, Structural basis for immunization with postfusion respiratory syncytial virus fusion F glycoprotein (RSV F) to elicit high neutralizing antibody titers. *Proc Natl Acad Sci USA* 108, 9619-9624 (2011).
13. L. Liljeroos, M. A. Krzyzaniak, A. Helenius, S. J. Butcher, Architecture of respiratory syncytial virus revealed by electron cryotomography. *Proc Natl Acad Sci USA* 110, 11133-11138 (2013).
14. A. Krarup, D. Truan, P. Furmanova-Hollenstein, L. Bogaert, P. Bouchier, I. J. Bisschop, M. N. Widjojoatmodjo, R. Zahn, H. Schuitemaker, J. S. McLellan, J. P. Langedijk, A highly stable prefusion RSV F vaccine derived from structural analysis of the fusion mechanism. *Nat Commun* 6, 8143 (2015).
15. J. S. McLellan, M. Chen, M. G. Joyce, M. Sastry, G. B. Stewart-Jones, Y. Yang, B. Zhang, L. Chen, S. Srivatsan, A. Zheng, T. Zhou, K. W. Graepel, A. Kumar, S. Moin, J. C. Boyington, G. Y. Chuang, C. Soto, U. Baxa, A. Q. Bakker, H. Spits, T. Beaumont, Z. Zheng, N. Xia, S. Y. Ko, J. P. Todd, S. Rao, B. S. Graham, P. D. Kwong, Structure-based design of a fusion glycoprotein vaccine for respiratory syncytial virus. *Science* 342, 592-598 (2013).
16. M. J. Kwakkenbos, S. A. Diehl, E. Yasuda, A. Q. Bakker, C. M. van Geelen, M. V. Lukens, G. M. van Bleek, M. N. Widjojoatmodjo, W. M. Bogers, H. Mei, A. Radbruch, F. A. Scheeren, H. Spits, T. Beaumont, Generation of stable monoclonal antibody-producing B cell receptor-positive human memory B cells by genetic programming. *Nat Med* 16, 123-128 (2010).
17. D. Corti, S. Bianchi, F. Vanzetta, A. Minola, L. Perez, G. Agatic, B. Guarino, C. Silacci, J. Marcandalli, B. J. Marsland, A. Piralla, E. Percivalle, F. Sallusto, F. Baldanti, A. Lanzavecchia, Cross-neutralization of four paramyxoviruses by a human monoclonal antibody. *Nature* 501, 439-443 (2013).
18. M. Magro, D. Andreu, P. Gomez-Puertas, J. A. Melero, C. Palomo, Neutralization of human respiratory syncytial virus infectivity by antibodies and low-molecular-weight compounds targeted against the fusion glycoprotein. *J Virol* 84, 7970-7982 (2010).
19. G. Taylor, E. J. Stott, J. Furze, J. Ford, P. Sopp, Protective epitopes on the fusion protein of respiratory syncytial virus recognized by murine and bovine monoclonal antibodies. *J Gen Virol* 73 (Pt 9), 2217-2223 (1992).
20. L. J. Calder, L. Gonzalez-Reyes, B. Garcia-Barreno, S. A. Wharton, J. J. Skehel, D. C. Wiley, J. A. Melero, Electron microscopy of the human respiratory syncytial virus fusion protein and complexes that it forms with monoclonal antibodies. *Virology* 271, 122-131 (2000).
21. M. S. Gilman, S. M. Moin, V. Mas, M. Chen, N. K. Patel, K. Kramer, Q. Zhu, S. C. Kabeche, A. Kumar, C. Palomo, T. Beaumont, U. Baxa, N. D. Ulbrandt, J. A. Melero, B. S. Graham, J. S. McLellan, Characterization of a Prefusion-Specific Antibody That Recognizes a Quaternary, Cleavage-Dependent Epitope on the RSV Fusion Glycoprotein. *PLoS Pathog* 11, e1005035 (2015).
22. M. G. Joyce, A. K. Wheatley, P. V. Thomas, G. Y. Chuang, C. Soto, R. T. Bailer, A. Druz, I. S. Georgiev, R. A. Gillespie, M. Kanekiyo, W. P. Kong, K. Leung, S. N. Narpala, M. S. Prabhakaran, E. S. Yang, B. Zhang, Y. Zhang, M. Asokan, J. C. Boyington, T. Bylund, S. Darko, C. R. Lees, A. Ransier, C. H. Shen, L. Wang, J. R. Whittle, X. Wu, H. M. Yassine, C. Santos, Y. Matsuoka, Y. Tsybovsky, U. Baxa, J. C. Mullikin, K. Subbarao, D. C. Douek, B. S. Graham, R. A. Koup, J. E. Ledgerwood, M. Roederer, L. Shapiro, P. D. Kwong, J. R. Mascola, A. B. McDermott, Vaccine-Induced Antibodies that Neutralize Group 1 and Group 2 Influenza A Viruses. *Cell* 166, 609-623 (2016).
23. J. Truck, M. N. Ramasamy, J. D. Galson, R. Rance, J. Parkhill, G. Lunter, A. J. Pollard, D. F. Kelly, Identification of antigen-specific B cell receptor sequences using public repertoire analysis. *J Immunol* 194, 252-261 (2015).
24. P. Parameswaran, Y. Liu, K. M. Roskin, K. K. Jackson, V. P. Dixit, J. Y. Lee, K. L. Artiles, S. Zompi, M. J. Vargas, B. B. Simen, B. Hanczaruk, K. R. McGowan, M. A. Tariq, N. Pourmand, D. Koller, A. Balmaseda, S. D. Boyd, E. Harris, A. Z. Fire, Convergent antibody signatures in human dengue. *Cell host & microbe* 13, 691-700 (2013).
25. K. J. Jackson, Y. Liu, K. M. Roskin, J. Glanville, R. A. Hoh, K. Seo, E. L. Marshall, T. C. Gurley, M. A. Moody, B. F. Haynes, E. B. Walter, H. X. Liao, R. A. Albrecht, A. Garcia-Sastre, J. Chaparro-Riggers, A. Rajpal, J. Pons, B. B. Simen, B. Hanczaruk, C. L. Dekker, J. Laserson, D. Koller, M. M. Davis, A. Z. Fire, S. D. Boyd, Human responses to influenza vaccination show seroconversion signatures and convergent antibody rearrangements. *Cell host & microbe* 16, 105-114 (2014).

26. F. W. Henderson, A. M. Collier, W. A. Clyde, Jr., F. W. Denny, Respiratory-syncytial-virus infections, reinfections and immunity. A prospective, longitudinal study in young children. *The New England journal of medicine* 300, 530-534 (1979).
27. M. A. Moody, B. F. Haynes, Antigen-specific B cell detection reagents: use and quality control. *Cytometry A* 73, 1086-1092 (2008).
28. M. S. Habibi, A. Jozwik, S. Makris, J. Dunning, A. Paras, J. P. DeVincenzo, C. A. de Haan, J. Wrammert, P. J. Openshaw, C. Chiu, I. Mechanisms of Severe Acute Influenza Consortium, Impaired Antibody-mediated Protection and Defective IgA B-Cell Memory in Experimental Infection of Adults with Respiratory Syncytial Virus. *Am J Respir Crit Care Med* 191, 1040-1049 (2015).
29. T. Tiller, E. Meffre, S. Yurasov, M. Tsuiji, M. C. Nussenzweig, H. Wardemann, Efficient generation of monoclonal antibodies from single human B cells by single cell RT-PCR and expression vector cloning. *J Immunol Methods* 329, 112-124 (2008).
30. Z. A. Bornholdt, H. L. Turner, C. D. Murin, W. Li, D. Sok, C. A. Souders, A. E. Piper, A. Goff, J. D. Shamblin, S. E. Wollen, T. R. Sprague, M. L. Fusco, K. B. Pommert, L. A. Cavacini, H. L. Smith, M. Klempner, K. A. Reimann, E. Krauland, T. U. Gerngross, K. D. Wittrup, E. O. Saphire, D. R. Burton, P. J. Glass, A. B. Ward, L. M. Walker, Isolation of potent neutralizing antibodies from a survivor of the 2014 Ebola virus outbreak. *Science* 351, 1078-1083 (2016).
31. J. F. Scheid, H. Mouquet, N. Feldhahn, M. S. Seaman, K. Velinzon, J. Pietzsch, R. G. Ott, R. M. Anthony, H. Zebroski, A. Hurley, A. Phogat, B. Chakrabarti, Y. Li, M. Connors, F. Pereyra, B. D. Walker, H. Wardemann, D. Ho, R. T. Wyatt, J. R. Mascola, J. V. Ravetch, M. C. Nussenzweig, Broad diversity of neutralizing antibodies isolated from memory B cells in HIV-infected individuals. *Nature* 458, 636-640 (2009).
32. J. Wrammert, K. Smith, J. Miller, W. A. Langley, K. Kokko, C. Larsen, N. Y. Zheng, I. Mays, L. Garman, C. Helms, J. James, G. M. Air, J. D. Capra, R. Ahmed, P. C. Wilson, Rapid cloning of high-affinity human monoclonal antibodies against influenza virus. *Nature* 453, 667-671 (2008).
33. S. D. Boyd, B. A. Gaeta, K. J. Jackson, A. Z. Fire, E. L. Marshall, J. D. Merker, J. M. Maniar, L. N. Zhang, B. Sahaf, C. D. Jones, B. B. Simen, B. Hanczaruk, K. D. Nguyen, K. C. Nadeau, M. Egholm, D. B. Miklos, J. L. Zehnder, A. M. Collins, Individual variation in the germline Ig gene repertoire inferred from variable region gene rearrangements. *J Immunol* 184, 6986-6992 (2010).
34. J. Sui, W. C. Hwang, S. Perez, G. Wei, D. Aird, L. M. Chen, E. Santelli, B. Stec, G. Cadwell, M. Ali, H. Wan, A. Murakami, A. Yammanuru, T. Han, N. J. Cox, L. A. Bankston, R. O. Donis, R. C. Liddington, W. A. Marasco, Structural and functional bases for broad-spectrum neutralization of avian and human influenza A viruses. *Nat Struct Mol Biol* 16, 265-273 (2009).
35. C. C. Huang, M. Venturi, S. Majeed, M. J. Moore, S. Phogat, M. Y. Zhang, D. S. Dimitrov, W. A. Hendrickson, J. Robinson, J. Sodroski, R. Wyatt, H. Choe, M. Farzan, P. D. Kwong, Structural basis of tyrosine sulfation and VH-gene usage in antibodies that recognize the HIV type 1 coreceptor-binding site on gp120. *Proc Natl Acad Sci USA* 101, 2706-2711 (2004).
36. C. H. Chan, K. G. Hadlock, S. K. Foung, S. Levy, V(H)1-69 gene is preferentially used by hepatitis C virus-associated B cell lymphomas and by normal B cells responding to the E2 viral antigen. *Blood* 97, 1023-1026 (2001).
37. E. E. Godoy-Lozano, J. Tellez-Sosa, G. Sanchez-Gonzalez, H. Samano-Sanchez, A. Aguilar-Salgado, A. Salinas-Rodriguez, B. Cortina-Ceballos, H. Vivanco-Cid, K. Hernandez-Flores, J. M. Pfaff, K. M. Kahle, B. J. Doranz, R. E. Gomez-Barreto, H. Valdovinos-Torres, I. Lopez-Martinez, M. H. Rodriguez, J. Martinez-Barnetche, Lower IgG somatic hypermutation rates during acute dengue virus infection is compatible with a germinal center-independent B cell response. *Genome Med* 8, 23 (2016).
38. J. Wrammert, D. Koutsonanos, G. M. Li, S. Edupuganti, J. Sui, M. Morrissey, M. McCausland, I. Skountzou, M. Hornig, W. I. Lipkin, A. Mehta, B. Razavi, C. Del Rio, N. Y. Zheng, J. H. Lee, M. Huang, Z. Ali, K. Kaur, S. Andrews, R. R. Amara, Y. Wang, S. R. Das, C. D. O'Donnell, J. W. Yewdell, K. Subbarao, W. A. Marasco, M. J. Mulligan, R. Compans, R. Ahmed, P. C. Wilson, Broadly cross-reactive antibodies dominate the human B cell response against 2009 pandemic H1N1 influenza virus infection. *J Exp Med* 208, 181-193 (2011).
39. S. F. Andrews, Y. Huang, K. Kaur, L. I. Popova, I. Y. Ho, N. T. Pauli, C. J. Henry Dunand, W. M. Taylor, S. Lim, M. Huang, X. Qu, J. H. Lee, M. Salgado-Ferrer, F. Krammer, P. Palese, J. Wrammert, R. Ahmed, P. C. Wilson, Immune history profoundly affects broadly protective B cell responses to influenza. *Sci Transl Med* 7, 316ra192 (2015).
40. M. Liu, G. Yang, K. Wiehe, N. I. Nicely, N. A. Vandergrift, W. Rountree, M. Bonsignori, S. M. Alam, J. Gao, B. F. Haynes, G. Kelsoe, Polyreactivity and autoreactivity among HIV-1 antibodies. *J Virol* 89, 784-798 (2015).
41. H. Mouquet, J. F. Scheid, M. J. Zoller, M. Krogsgaard, R. G. Ott, S. Shukair, M. N. Artyomov, J. Pietzsch, M. Connors, F. Pereyra, B. D. Walker, D. D. Ho, P. C. Wilson, M. S. Seaman, H. N. Eisen, A. K. Chakraborty, T. J. Hope, J. V. Ravetch, H. Wardemann, M. C. Nussenzweig, Polyreactivity increases the apparent affinity of anti-HIV antibodies by heteroligation. *Nature* 467, 591-595 (2010).
42. R. L. Kelly, T. Sun, T. Jain, I. Caffry, Y. Yu, Y. Cao, H. Lynaugh, M. Brown, M. Vasquez, K. D. Wittrup, Y. Xu, High throughput cross-interaction measures for human IgG1 antibodies correlate with clearance rates in mice. *MAbs,* 0 (2015).
43. Y. Xu, W. Roach, T. Sun, T. Jain, B. Prinz, T. Y. Yu, J. Torrey, J. Thomas, P. Bobrowicz, M. Vasquez, K. D. Wittrup, E. Krauland, Addressing polyspecificity of antibodies selected from an in vitro yeast presentation system: a FACS-based, high-throughput selection and analytical tool. *Protein Eng Des Sel* 26, 663-670 (2013).
44. D. R. Bowley, A. F. Labrijn, M. B. Zwick, D. R. Burton, Antigen selection from an HIV-1 immune antibody library displayed on yeast yields many novel antibodies compared to selection from the same library displayed on phage. *Protein Eng Des Sel* 20, 81-90 (2007).
45. H. Wu, D. S. Pfarr, S. Johnson, Y. A. Brewah, R. M. Woods, N. K. Patel, W. I. White, J. F. Young, P. A. Kiener, Development of motavizumab, an ultra-potent antibody for the prevention of respiratory syncytial virus infection in the upper and lower respiratory tract. *Journal of molecular biology* 368, 652-665 (2007).
46. J. S. McLellan, M. Chen, J. S. Chang, Y. Yang, A. Kim, B. S. Graham, P. D. Kwong, Structure of a major antigenic site on the respiratory syncytial virus fusion glycoprotein in complex with neutralizing antibody 101F. *J Virol* 84, 12236-12244 (2010).
47. P. W. Parren, D. R. Burton, The antiviral activity of antibodies in vitro and in vivo. *Advances in immunology* 77, 195-262 (2001).
48. J. Foote, H. N. Eisen, Kinetic and affinity limits on antibodies produced during immune responses. *Proc Natl Acad Sci USA* 92, 1254-1256 (1995).
49. F. D. Batista, M. S. Neuberger, Affinity dependence of the B cell response to antigen: a threshold, a ceiling, and the importance of off-rate. *Immunity* 8, 751-759 (1998).
50. J. E. Schuster, R. G. Cox, A. K. Hastings, K. L. Boyd, J. Wadia, Z. Chen, D. R. Burton, R. A. Williamson, J. V. Williams, A broadly neutralizing human monoclonal antibody exhibits in vivo efficacy against both human metapneumovirus and respiratory syncytial virus. *J Infect Dis* 211, 216-225 (2015).
51. B. F. Fernie, P. J. Cote, Jr., J. L. Gerin, Classification of hybridomas to respiratory syncytial virus glycoproteins. Proceedings of the Society for Experimental Biology and Medicine. Society for Experimental Biology and Medicine (New York, N.Y.) 171, 266-271 (1982).
52. P. J. Cote, Jr., B. F. Fernie, E. C. Ford, J. W. Shih, J. L. Gerin, Monoclonal antibodies to respiratory syncytial virus: detection of virus neutralization and other antigen-antibody systems using infected human and murine cells. *Journal of virological methods* 3, 137-147 (1981).
53. E. E. Walsh, J. Hruska, Monoclonal antibodies to respiratory syncytial virus proteins: identification of the fusion protein. *J Virol* 47, 171-177 (1983).
54. L. J. Anderson, P. Bingham, J. C. Hierholzer, Neutralization of respiratory syncytial virus by individual and mixtures of F and G protein monoclonal antibodies. *J Virol* 62, 4232-4238 (1988).
55. G. E. Scopes, P. J. Watt, P. R. Lambden, Identification of a linear epitope on the fusion glycoprotein of respiratory syncytial virus. *J Gen Virol* 71 (Pt 1), 53-59 (1990).
56. J. Arbiza, G. Taylor, J. A. Lopez, J. Furze, S. Wyld, P. Whyte, E. J. Stott, G. Wertz, W. Sullender, M. Trudel, et al., Characterization of two antigenic sites recognized by neutralizing monoclonal antibodies directed against the fusion glycoprotein of human respiratory syncytial virus. *J Gen Virol* 73 (Pt 9), 2225-2234 (1992).
57. J. A. Lopez, R. Bustos, C. Orvell, M. Berois, J. Arbiza, B. Garcia-Barreno, J. A. Melero, Antigenic structure of human respiratory syncytial virus fusion glycoprotein. *J Virol* 72, 6922-6928 (1998).
58. B. J. DeKosky, T. Kojima, A. Rodin, W. Charab, G. C. Ippolito, A. D. Ellington, G. Georgiou, In-depth determination and analysis of the human paired heavy- and light-chain antibody repertoire. *Nat Med* 21, 86-91 (2015).
59. U.S. National Library of Medicine, (NCT02290340, https://clinicaltrials.gov/).
60. PATH, RSV Vaccine Snapshot (2016 http://sites.path.org/vaccinedevelopment/files/2016/07/RSV-snapshot-July_13_2016.pdf).
61. B. S. Graham, M. D. Perkins, P. F. Wright, D. T. Karzon, Primary respiratory syncytial virus infection in mice. *Journal of medical virology* 26, 153-162 (1988).
62. A. L. Hotard, F. Y. Shaikh, S. Lee, D. Yan, M. N. Teng, R. K. Plemper, J. E. Crowe, Jr., M. L. Moore, A stabilized respiratory syncytial virus reverse genetics system amenable to recombination-mediated mutagenesis. *Virology* 434, 129-136 (2012).

An informal sequence listing is provided in Table 6, below. The informal sequence listing provides the following sixteen (16) sequence elements contained in each of the 123 antibodies, identified as described above and designated as Antibody Numbers (Ab #) 1 through 123, in the following order:

Heavy chain variable region ("HC") nucleic acid sequence
Heavy chain variable region ("HC") amino acid sequence
Heavy chain variable region CDR H1 ("H1") amino acid sequence
Heavy chain variable region CDR H1 ("H1") nucleic acid sequence
Heavy chain variable region CDR H2 ("H2") amino acid sequence
Heavy chain variable region CDR H2 ("H2") nucleic acid sequence
Heavy chain variable region CDR H3 ("H3") amino acid sequence
Heavy chain variable region CDR H3 ("H3") nucleic acid sequence
Light chain variable region ("LC") nucleic acid sequence
Light chain variable region ("LC") amino acid sequence
Light chain variable region CDR L1 ("L1") amino acid sequence
Light chain variable region CDR L1 ("L1") nucleic acid sequence
Light chain variable region CDR L2 ("L2") amino acid sequence
Light chain variable region CDR L2 ("L2") nucleic acid sequence
Light chain variable region CDR L3 ("L3") amino acid sequence
Light chain variable region CDR L3 ("L3") nucleic acid sequence

TABLE 6

Informal Sequence Listing

| Antibody No. | Seq. Ref. No. | SEQ ID NO. | Sequence |
|---|---|---|---|
| 1 | 1 | 1 | CAGGTCCAGCTTGTACAGTCTGGGGCTGAGGTGAAGAAGCCTGGGGC CTCAGTGAAGGTGTCCTGCAGGGCTTCTGGATTCGTCTTCACCAGTTA TGATATCAACTGGGTGCGACAGGCCCCGGGGCAAGGTCTTGAGTGGA TGGGGCGAATGAACGCTCACACTGGACAGGTGACGTATGCCCAGAAA TTCCAGGACAAAGTCTCCATGACCAGGGACGTCTCCATAACGACAGC CTACCTGGAACTGAGTCGCCTGGCATCTGAGGACACGGCCGTCTATT ACTGTGCGAGGCCCGACATTAACTGGGGTCAAGATGCTTTTGATGTCT GGGGCCAGGGCACAATGGTCACCGTCTCTTCA |

TABLE 6-continued

Informal Sequence Listing

| Antibody No. | Seq. Ref. No. | SEQ ID NO. | Sequence |
|---|---|---|---|
| 1 | 2 | 2 | QVQLVQSGAEVKKPGASVKVSCRASGFVFTSYDINWVRQAPGQGLEW MGRMNAHTGQVTYAQKFQDKVSMTRDVSITTAYLELSRLASEDTAVYY CARPDINWGQDAFDVWGQGTMVTVSS |
| 1 | 3 | 3 | FVFTSYDIN |
| 1 | 4 | 4 | TTCGTCTTCACCAGTTATGATATCAAC |
| 1 | 5 | 5 | RMNAHTGQVTYAQKFQD |
| 1 | 6 | 6 | CGAATGAACGCTCACACTGGACAGGTGACGTATGCCCAGAAATTCCA GGAC |
| 1 | 7 | 7 | ARPDINWGQDAFDV |
| 1 | 8 | 8 | GCGAGGCCCGACATTAACTGGGGTCAAGATGCTTTTGATGTC |
| 1 | 9 | 9 | GACATCCGGATGACCCAGTCTCCTTCCACCCTGTCTGCATCTATAGGA GCCAGAGTCACCATCACTTGCCGGGCCAGTCAGAATATTGGTAACTT CTTGGCCTGGTATCAGCAGAAGCCAGGGAAAGCCCCTAAACTCCTGA TCTATAAGGCGTCTACTTTAGATCCTGGGGTCCCATCAAGGTTCAGCG GCAGCGGATCTGGGACAGAATTCACTCTCACCATCACCAGCCTGCAG CCTGATGATTTCGCAACATTTTACTGCCAACAGTATAAGAGTGACCCC ACTTTTGGCCAGGGGACCAAGGTGGAAATCAAA |
| 1 | 10 | 10 | DIRMTQSPSTLSASIGARVTITCRASQNIGNFLAWYQQKPGKAPKLLIYK ASTLDPGVPSRFSGSGSGTEFTLTITSLQPDDFATFYCQQYKSDPTFGQGT KVEIK |
| 1 | 11 | 11 | RASQNIGNFLA |
| 1 | 12 | 12 | CGGGCCAGTCAGAATATTGGTAACTTCTTGGCC |
| 1 | 13 | 13 | KASTLDP |
| 1 | 14 | 14 | AAGGCGTCTACTTTAGATCCT |
| 1 | 15 | 15 | QQYKSDPT |
| 1 | 16 | 16 | CAACAGTATAAGAGTGACCCCACT |
| 2 | 17 | 17 | CAGGTCCAGCTGGTGCAGTCTGGGGCTGAGGTGAAGAAGCCTGGGTC ATCGGTGAGGGTCTCCTGTAGGGCTTCAGGAGTCACTTTGACCACCGT TGCTGTCAACTGGGTGCGCCAGGTCCCTGGGCAAGGGCCTGAGTGGA TTGGAGGGATCCTCGTTGGGCTTGGTAAGGTCAGACTCGCCCAGAAA TTTGAGAATCGAGCCACTCTAAGGGCGGACACATCTAGCAACACAGC CTACATGGAGTTGAGCGGCCTGAGATTTGAGGACACGGCCGTCTATT ATTGTGCGATAATCGACCCCCAAGATTGTACTGCTGCCAGCTGCTTTT GGGTCAACTGGCTCGACCCCTGGGGCCAGGGAACCCTGGTCACCGTC TCCTCA |
| 2 | 18 | 18 | QVQLVQSGAEVKKPGSSVRVSCRASGVTLTTVAVNWVRQVPGQGPEWI GGILVGLGKVRLAQKFENRATLRADTSSNTAYMELSGLRFEDTAVYYCA IIDPQDCTAASCFWVNWLDPWGQGTLVTVSS |
| 2 | 19 | 19 | VTLTTVAVN |
| 2 | 20 | 20 | GTCACTTTGACCACCGTTGCTGTCAAC |
| 2 | 21 | 21 | GILVGLGKVRLAQKFEN |
| 2 | 22 | 22 | GGGATCCTCGTTGGGCTTGGTAAGGTCAGACTCGCCCAGAAATTTGA GAAT |
| 2 | 23 | 23 | AIIDPQDCTAASCFWVNWLDP |
| 2 | 24 | 24 | GCGATAATCGACCCCCAAGATTGTACTGCTGCCAGCTGCTTTTGGGTC AACTGGCTCGACCCC |
| 2 | 25 | 25 | GAAATTGTATTGACGCAGTCTCCAGGCACCCTGACCTTGTCTCCAGGG GAGACAGCCACCCTCTCCTGCAGGGCCAGTCAGAGTGTTCTTAGTGG CTACTTAGCCTGGTACCAGCAGAAACCTGGCCAGGCTCCCAGGCTCC TCATCTATGCTGCATCCACTAGGGCCACTGACATCCCAGCGAGGTTCA |

TABLE 6-continued

Informal Sequence Listing

| Antibody No. | Seq. Ref. No. | SEQ ID NO. | Sequence |
|---|---|---|---|
| | | | CTGGCAGTGGGTCTGCGACAGACTTCACTCTCACCATCAGCAGACTG GAGCCTCAAGATTTTGCAGTGTATTACTGTCAGCAGTATGGTTCGGCT CCGATCACCTTCGGCCAAGGGACACGACTGGAGATTAAA |
| 2 | 26 | 26 | EIVLTQSPGTLTLSPGETATLSCRASQSVLSGYLAWYQQKPGQAPRLLIY AASTRATDIPARFTGSGSATDFTLTISRLEPQDFAVYYCQQYGSAPITFGQ GTRLEIK |
| 2 | 27 | 27 | RASQSVLSGYLA |
| 2 | 28 | 28 | AGGGCCAGTCAGAGTGTTCTTAGTGGCTACTTAGCC |
| 2 | 29 | 29 | AASTRAT |
| 2 | 30 | 30 | GCTGCATCCACTAGGGCCACT |
| 2 | 31 | 31 | QQYGSAPIT |
| 2 | 32 | 32 | CAGCAGTATGGTTCGGCTCCGATCACC |
| 3 | 33 | 33 | CAGGTCCAGCTGGTGCAGTCTGGGGCTGAGGTAAAGAAGCCTGGGTC ATCGGTGAAGGTCTCCTGCAAGGCCTCTGGAGGCACCATCAACAACG TTGCTATCAGTTGGCTGCGACAGGCCCCTGGACAAGGCCTGGAGTGG CTGGGAGGGAACATCCCTGGCTTTGGTAAAGTCAGATACTCACAGCA GTTTGAGACCAGACTCACTTTAACCGCGGACGTCTCGTCCGACACAG CCTACATGGTGTTGACCAGCCTAAGATCTGAAGACACGGCCGTCTATT ACTGTGCGATCATCGACCCCCAACTTTGCACCAGAGCCAGCTGCTTTT GGGTCAACTGGCTCGACCCCTGGGGCCAGGGGACCACGGTCACCGTC TCCTCA |
| 3 | 34 | 34 | QVQLVQSGAEVKKPGSSVKVSCKASGGTINNVAISWLRQAPGQGLEWL GGNIPGFGKVRYSQQFETRLTLTADVSSDTAYMVLTSLRSEDTAVYYCAI IDPQLCTRASCFWVNWLDPWGQGTTVTVSS |
| 3 | 35 | 35 | GTINNVAIS |
| 3 | 36 | 36 | GGCACCATCAACAACGTTGCTATCAGT |
| 3 | 37 | 37 | GNIPGFGKVRYSQQFET |
| 3 | 38 | 38 | GGGAACATCCCTGGCTTTGGTAAAGTCAGATACTCACAGCAGTTTGA GACC |
| 3 | 39 | 39 | AIIDPQLCTRASCFWVNWLDP |
| 3 | 40 | 40 | GCGATCATCGACCCCCAACTTTGCACCAGAGCCAGCTGCTTTTGGGTC AACTGGCTCGACCCC |
| 3 | 41 | 41 | GATATTGTGATGACTCAGTCTCCAGGCACCCTGTCTGTGTCTCCAGGG GAGAGTGCCGCCCTCTCCTGCGGGGCCAGTGAGAGTATTCTCAGCGA CTCCTTAGCCTGGTACCAGCATAAACCTGGTCAGGCTCCCAGGCTCCT CATCTATGGTGCATCCAGTAGGGCCGCTGGCATCCCAGACAGGTTCA GTGGCAGTGGGTCTGGGACAGACTTCACTCTCACCATCAGCAGACTG GAGCCAGAGGATTTTGCAGTGTATTTCTGTCAACAGTTTGGTGCCTTA CCGATCACTTTCGGCCAAGGGACACGACTGGAGATTAAA |
| 3 | 42 | 42 | DIVMTQSPGTLSVSPGESAALSCGASESILSDSLAWYQHKPGQAPRLLIY GASSRAAGIPDRFSGSGSGTDFTLTISRLEPEDFAVYFCQQFGALPITFGQ GTRLEIK |
| 3 | 43 | 43 | GASESILSDSLA |
| 3 | 44 | 44 | GGGGCCAGTGAGAGTATTCTCAGCGACTCCTTAGCC |
| 3 | 45 | 45 | GASSRAA |
| 3 | 46 | 46 | GGTGCATCCAGTAGGGCCGCT |
| 3 | 47 | 47 | QQFGALPIT |
| 3 | 48 | 48 | CAACAGTTTGGTGCCTTACCGATCACT |
| 4 | 49 | 49 | CAGGTGCAGCTGGTGCAATCTGGGGCTGAGGTGAAGAAGCCGGGGTC CTCGGTGAAAATCTCCTGTAAGGCTTCTGGAGGCACCTTCAACAGTCA |

TABLE 6-continued

Informal Sequence Listing

| Antibody Ref. No. | Seq. Ref. No. | SEQ ID NO. | Sequence |
|---|---|---|---|
| | | | AGCAATTCACTGGGTGCGACAGGCCCCTGGACAAGACCTTGAGTGGA<br>TGGGAAACATCATCCCTGGGTTCGGATCACCAAACTCCGCGCAGAAC<br>TTCCAGGGCAGGGTCACCTTCATTGCGGACGATTCCACTGGCGCTGCC<br>TACATGGACTTGAGTAGCCTGAAGTCTGAAGACACGGCCGTCTATTA<br>CTGTGCGACAGCCGGGTGGTTCGGGGAATCAGTTCATTTGGACTCAT<br>GGGGCCAGGGAACCCTGGTCACCGTCTCCTCA |
| 4 | 50 | 50 | QVQLVQSGAEVKKPGSSVKISCKASGGTFNSQAIHWVRQAPGQDLEWM<br>GNIIPGFGSPNSAQNFQGRVTFIADDSTGAAYMDLSSLKSEDTAVYYCAT<br>AGWFGESVHLDSWGQGTLVTVSS |
| 4 | 51 | 51 | GTFNSQAIH |
| 4 | 52 | 52 | GGCACCTTCAACAGTCAAGCAATTCAC |
| 4 | 53 | 53 | NIIPGFGSPNSAQNFQG |
| 4 | 54 | 54 | AACATCATCCCTGGGTTCGGATCACCAAACTCCGCGCAGAACTTCCA<br>GGGC |
| 4 | 55 | 55 | ATAGWFGESVHLDS |
| 4 | 56 | 56 | GCGACAGCCGGGTGGTTCGGGGAATCAGTTCATTTGGACTCA |
| 4 | 57 | 57 | GATATTGTGATGACTCAGTCTCCAGCCACCCTGTCTGTGTCTCCAGGG<br>GAAAGAGCCACCCTCTCCTGCAGGGCCAGTGAGAGTGTTAGCAGCAA<br>CTTAGCCTGGTACCAGCAGAAACCTGGCCAGGCTCCCAGGCTCCTCA<br>TCTATGGTGCATCCACCAGGGCCACTGGTATCCCAGCCAGGTTCAGTG<br>GCAGTGGGTCAGGGACGGAGTTCACTCTCACCATCAACAGCCTGCAG<br>TCTGAAGATTTTGCAGTTTATTACTGTCAGCAGTATAATAACTGGCCT<br>CCTCTCACTTTCGGCGGAGGGACCAAGGTGGAAATCAAA |
| 4 | 58 | 58 | DIVMTQSPATLSVSPGERATLSCRASESVSSNLAWYQQKPGQAPRLLIYG<br>ASTRATGIPARFSGSGSGTEFTLTINSLQSEDFAVYYCQQYNNWPPLTFG<br>GGTKVEIK |
| 4 | 59 | 59 | RASESVSSNLA |
| 4 | 60 | 60 | AGGGCCAGTGAGAGTGTTAGCAGCAACTTAGCC |
| 4 | 61 | 61 | GASTRAT |
| 4 | 62 | 62 | GGTGCATCCACCAGGGCCACT |
| 4 | 63 | 63 | QQYNNWPPLT |
| 4 | 64 | 64 | CAGCAGTATAATAACTGGCCTCCTCTCACT |
| 5 | 65 | 65 | CAGGTCCAGCTGGTACAGTCTGGAAGTGAGGTGAAGAAGCCTGGGGC<br>CTCGGTGAAGGTCTCCTGCAAGGCCTCAGGTTACAGGTTTTCCAACTA<br>TGGTATCAGCTGGGTGCGACAGGCCCCTGGACAAGGCCTAGAGTGGA<br>TGGGATGGATCAGCGCTTACAATGGAAACATAAAGTATGGAAATAAC<br>CTCCAGGGCAGAGTCACCGTGACCACAGACACATCCACGGCCACGGC<br>CTACATGGAGGTGAGGAGCCTGACATCTGACGACACGGCCGTGTATT<br>ACTGTGCGAGAGATGTCCCAGCTGACGGGGTCCACTTCATGGACGTC<br>TGGGGCCAAGGAACCCTGGTCACCGTCTCCTCA |
| 5 | 66 | 66 | QVQLVQSGSEVKKPGASVKVSCKASGYRFSNYGISWVRQAPGQGLEWM<br>GWISAYNGNIKYGNNLQGRVTTTDTSTATAYMEVRSLTSDDTAVYYC<br>ARDVPADGVHFMDVWGQGTLVTVSS |
| 5 | 67 | 67 | YRFSNYGIS |
| 5 | 68 | 68 | TACAGGTTTTCCAACTATGGTATCAGC |
| 5 | 69 | 69 | WISAYNGNIKYGNNLQG |
| 5 | 70 | 70 | TGGATCAGCGCTTACAATGGAAACATAAAGTATGGAAATAACCTCCA<br>GGGC |
| 5 | 71 | 71 | ARDVPADGVHFMDV |
| 5 | 72 | 72 | GCGAGAGATGTCCCAGCTGACGGGGTCCACTTCATGGACGTC |

TABLE 6-continued

Informal Sequence Listing

| Antibody No. | Seq. Ref. No. | SEQ ID NO. | Sequence |
|---|---|---|---|
| 5 | 73 | 73 | GAAATTGTAATGACACAGTCTCCACTCTCCCTGCCCGTCACCCTTGGA CAGCCGGCCTCCATCTCCTGCAGGTCTAGTCAAAGCCTCGTACACAGT GATACTAACACCTACTTGAACTGGTTTCAGCAGAGGCCAGGCCAATC TCCACGGCGCCTAATTTATAAGGTTTCTAACCGGGACTCTGGGGTCCC AGACAGATTCAGCGGCAGTGGGTCAGGCACTACTTTCACACTGAAAA TCAGCAGGGTGGAGGCTGAGGATGTTGGGATTTATTACTGCATGCAG GGTTCACACTGGGCTCCGACTTTCGGCCAGGGGACCAAGGTGGAAAT CAAA |
| 5 | 74 | 74 | EIVMTQSPLSLPVTLGQPASISCRSSQSLVHSDTNTYLNWFQQRPGQSPRR LIYKVSNRDSGVPDRFSGSGSGTTFTLKISRVEAEDVGIYYCMQGSHWAP TFGQGTKVEIK |
| 5 | 75 | 75 | RSSQSLVHSDTNTYLN |
| 5 | 76 | 76 | AGGTCTAGTCAAAGCCTCGTACACAGTGATACTAACACCTACTTGAAC |
| 5 | 77 | 77 | KVSNRDS |
| 5 | 78 | 78 | AAGGTTTCTAACCGGGACTCT |
| 5 | 79 | 79 | MQGSHWAPT |
| 5 | 80 | 80 | ATGCAGGGTTCACACTGGGCTCCGACT |
| 6 | 81 | 81 | CAGGTCCAGCTGGTGCAGTCTGGGACTGAGGTGAAGAAGCCTGGGTC CTCCGTGAAGGTCTCCTGCAAGGCTTCTGGAGGCACCTTCGGCAGCT ACGCTGTCATCTGGGTGCGACAGGCCCCTGGACAAGGGCTTGAATGG ATGGGACATTTCATCCCTGTGTTTGCTACAACAAACAAGGCACAGAA GTTCCAGGGCAGACTCACCCTTAGTACAGACGAATCTACGGGCACAG TCTACATGGAGCTGAGCAGCCTGAGATCTGAGGACACGGCCGTCTAT TTCTGTGCGACCAAGAGATATTGTAGTGATCCCAGCTGCCATGGACTC TGGTACTTCGATCTCTGGGGCCGTGGCACCCTGGTCACTGTCTCCTCA |
| 6 | 82 | 82 | QVQLVQSGTEVKKPGSSVKVSCKASGGTFGSYAVIWVRQAPGQGLEWM GHFIPVFATTNKAQKFQGRLTLSTDESTGTVYMELSSLRSEDTAVYFCAT KRYCSDPSCHGLWYFDLWGRGTLVTVSS |
| 6 | 83 | 83 | GTFGSYAVI |
| 6 | 84 | 84 | GGCACCTTCGGCAGCTACGCTGTCATC |
| 6 | 85 | 85 | HFIPVFATTNKAQKFQG |
| 6 | 86 | 86 | CATTTCATCCCTGTGTTTGCTACAACAAACAAGGCACAGAAGTTCCAG GGC |
| 6 | 87 | 87 | ATKRYCSDPSCHGLWYFDL |
| 6 | 88 | 88 | GCGACCAAGAGATATTGTAGTGATCCCAGCTGCCATGGACTCTGGTA CTTCGATCTC |
| 6 | 89 | 89 | GACATCCAGTTGACCCAGTCTCCACTCTCCCTGCCCGTCACCCCTGGA GAGCCGGCCTCCATCTCCTGCAGGTCTAGTCAGAGCCTCTTGGATAGT GATGATGGAAACACCTATTTGGACTGGTACCTGCAGAAGCCAGGGCA GTCTCCACAGGTCCTGATCTATATGCTTTCGTATCGGGCCTCTGGAGT CCCAGACAGGTTCAGTGGCAGTGGGTCAGGCACTGATTTCACACTAG AAATCAGCAGGGTGGAGGCTGAGGATGTTGGAGTTTATTACTGCATG CAACGTGTAGAGTTTCCTTACACTTTTGGCCAGGGGACCAAGCTGGA GATCAAA |
| 6 | 90 | 90 | DIQLTQSPLSLPVTPGEPASISCRSSQSLLDSDDGNTYLDWYLQKPGQSPQ VLIYMLSYRASGVPDRFSGSGSGTDFTLEISRVEAEDVGVYYCMQRVEFP YTFGQGTKLEIK |
| 6 | 91 | 91 | RSSQSLLDSDDGNTYLD |
| 6 | 92 | 92 | AGGTCTAGTCAGAGCCTCTTGGATAGTGATGATGGAAACACCTATTT GGAC |
| 6 | 93 | 93 | MLSYRAS |
| 6 | 94 | 94 | ATGCTTTCGTATCGGGCCTCT |

TABLE 6-continued

Informal Sequence Listing

| Antibody No. | Seq. Ref. No. | SEQ ID NO. | Sequence |
|---|---|---|---|
| 6 | 95 | 95 | MQRVEFPYT |
| 6 | 96 | 96 | ATGCAACGTGTAGAGTTTCCTTACACT |
| 7 | 97 | 97 | CAGGTCCAGCTGGTGCAGTCTGGGCCTGACGTGAAGAGACCTGGGGC<br>CTCAGTGAGAGTCTCCTGCAAGGCTTCTGGATACACCTTCAGCGACTA<br>CTATATGCACTGGGTGCGACAGGCCCCTGGACAGGGTCTTGAATGGC<br>TGGCTTGGGTCAACCCTAGCACTGGCGCCACACACTACTCAGAGAGT<br>TTTCGGGGCTCTATGGTCGTTCAAAGGGACACGTCCACCGACACAGC<br>CTACCTGGAGCTGAGTAGTCTGAAATCTGACGACACGGCCGTCTATT<br>ATTGTGCGAGAATCGGGAGTAATGAGATTTGGGGCCAGGGGACAATG<br>GTCACCGTCTCTTCA |
| 7 | 98 | 98 | QVQLVQSGPDVKRPGASVRVSCKASGYTFSDYYMHWVRQAPGQGLEW<br>LAWVNPSTGATHYSESFRGSMVVQRDTSTDTAYLELSSLKSDDTAVYYC<br>ARIGSNEIWGQGTMVTVSS |
| 7 | 99 | 99 | YTFSDYYMH |
| 7 | 100 | 100 | TACACCTTCAGCGACTACTATATGCAC |
| 7 | 101 | 101 | WVNPSTGATHYSESFRG |
| 7 | 102 | 102 | TGGGTCAACCCTAGCACTGGCGCCACACACTACTCAGAGAGTTTTCG<br>GGGC |
| 7 | 103 | 103 | ARIGSNEI |
| 7 | 104 | 104 | GCGAGAATCGGGAGTAATGAGATT |
| 7 | 105 | 105 | CAGTCTGCCCTGACTCAGCCTGCCTCCGTGTCTGGGTCCTGGACAG<br>TCGATCACCATCTCCTGCGCTGGACTTCCAGTGACATTGGTGGTTGG<br>AACTATGTCTCCTGGTACCAACAGTACCCCGGCCAAGTCCCCAAACTC<br>ATCCTTTATGAAGTCACTGATAGGCCCTCAGGGGTTTCTCATCGCTTC<br>TCTGGCTCCAAGTCTGGCAACAGGGCCTTCCTTACCATCACTGGGCTC<br>CGGGCCGAGGACGAGGCTGATTATTACTGCTGCTCATTTACTTCTTCC<br>GGCAGTAGGGTTTTCGGCGGAGGGACCAAGGTCACCGTCCTA |
| 7 | 106 | 106 | QSALTQPASVSGSPGQSITISCAGTSSDIGGWNYVSWYQQYPGQVPKLIL<br>YEVTDRPSGVSHRFSGSKSGNRAFLTITGLRAEDEADYYCCSFTSSGSRV<br>FGGGTKVTVL |
| 7 | 107 | 107 | AGTSSDIGGWNYVS |
| 7 | 108 | 108 | GCTGGCACTTCCAGTGACATTGGTGGTTGGAACTATGTCTCC |
| 7 | 109 | 109 | EVTDRPS |
| 7 | 110 | 110 | GAAGTCACTGATAGGCCCTCA |
| 7 | 111 | 111 | CSFTSSGSRV |
| 7 | 112 | 112 | TGCTCATTTACTTCTTCCGGCAGTAGGGTT |
| 8 | 113 | 113 | GAGGTGCAGCTGTTGGAGTCTGGGGCTGTGATGAAGAGGCCTGGGTC<br>ATCGGTGAGGGTCTCCTGCAGGGCTTCAGGAGTCACTTTGACCACCGT<br>TTCTGTCAACTGGGTGCGCCAGGTCCCTGGGCAAGGGCCTGAGTGGA<br>TTGGAGGGATCCTCATTGGGTTTGGTAAGGTCAGACAAGCCCAGAAA<br>TTTGAGAACCGAGTCACTCTGACCGCGGACGCATCAAGGAACACAGC<br>ATATATGGAGTTGAGCGGACTGACATCTGACGACACGGCCGTCTATT<br>ACTGTGCGATAATCGACCCCCAAGATTGTACTCGTGCCAGCTGCTTTT<br>GGGTCAACTGGCTCGACCCCTGGGGCCAGGGAACCCTGGTCACCGTC<br>TCCTCA |
| 8 | 114 | 114 | EVQLLESGAVMKRPGSSVRVSCRASGVTLTTVSVNWVRQVPGQGPEWI<br>GGILIGFGKVRQAQKFENRVTLTADASRNTAYMELSGLTSDDTAVYYCA<br>IIDPQDCTRASCFWVNWLDPWGQGTLVTVSS |
| 8 | 115 | 115 | VTLTTVSVN |
| 8 | 116 | 116 | GTCACTTTGACCACCGTTTCTGTCAAC |
| 8 | 117 | 117 | GILIGFGKVRQAQKFEN |

TABLE 6-continued

Informal Sequence Listing

| Antibody No. | Seq. Ref. No. | SEQ ID NO. | Sequence |
|---|---|---|---|
| 8 | 118 | 118 | GGGATCCTCATTGGGTTTGGTAAGGTCAGACAAGCCCAGAAATTTGAGAAC |
| 8 | 119 | 119 | AIIDPQDCTRASCFWVNWLDP |
| 8 | 120 | 120 | GCGATAATCGACCCCCAAGATTGTACTCGTGCCAGCTGCTTTTGGGTCAACTGGCTCGACCCC |
| 8 | 121 | 121 | GACATCCGGATGACCCAGTCTCCAGGCACCCTGACCTTGTCCCCAGGGGAGCGAGCCACCCTCTCCTGCAGGGCCAGTCAGAGTATTCTTAGCGGGAACTTAGCCTGGTACCAGCAGAAACCTGGCCAGGCTCCCAGGCTCCTCATCTCTGCTGCATCCACTAGGGCCACTGACATCCCAGACAGGTTCAGTGGCAGTGGGTCTGGGACAGACTTCACTCTCACCATCACCAGACTGGAGCCTCAAGATTTTGCAGTGTATTACTGTCAGCAGTATGATTCGGCTCCGATCACCTTCGGCCAAGGGACACGACTGGAGATTAAA |
| 8 | 122 | 122 | DIRMTQSPGTLTLSPGERATLSCRASQSILSGNLAWYQQKPGQAPRLLISAASTRATDIPDRFSGSGSGTDFTLTITRLEPQDFAVYYCQQYDSAPITFGQGTRLEIK |
| 8 | 123 | 123 | RASQSILSGNLA |
| 8 | 124 | 124 | AGGGCCAGTCAGAGTATTCTTAGCGGGAACTTAGCC |
| 8 | 125 | 125 | AASTRAT |
| 8 | 126 | 126 | GCTGCATCCACTAGGGCCACT |
| 8 | 127 | 127 | QQYDSAPIT |
| 8 | 128 | 128 | CAGCAGTATGATTCGGCTCCGATCACC |
| 9 | 129 | 129 | CAGGTCCAGCTTGTGCAGTCTGGGGCTGAGGTGAAGAAGCCTGGGTCCTCGGTGAAGGTCTCCTGCGAGGCTTCTGGAGACACCTTCACCAGTTATGCAGTCATCTGGGTGCGCCAGACCCCAGGACAAGGGCTTGAGTTCATGGGGAAGTATCATCCCTATCTTTCAAACAATAAACTACGCTCCGAAGTTCCAGGGGAGGGTCACCCTAAGCGCGGACGGATCCACGAGCACAGTCTTCATGGAGTTGCGAAACCTGAGATCTGAGGACACGGCCATATATTTCTGTGCGACCAAGAGATATTGTACTAGTCCCAGCTGCCATGGACTCTGGTACTTCAATCTCTGGGGCCGTGGCACAATGGTCACCGTCTCTTCA |
| 9 | 130 | 130 | QVQLVQSGAEVKKPGSSVKVSCEASGDTFTSYAVIWVRQTPGQGLEFMGSIIPIFQTINYAPKFQGRVTLSADGSTSTVFMELRNLRSEDTAIYFCATKRYCTSPSCHGLWYFNLWGRGTMVTVSS |
| 9 | 131 | 131 | DTFTSYAVI |
| 9 | 132 | 132 | GACACCTTCACCAGTTATGCAGTCATC |
| 9 | 133 | 133 | SIIPIFQTINYAPKFQG |
| 9 | 134 | 134 | AGTATCATCCCTATCTTTCAAACAATAAACTACGCTCCGAAGTTCCAGGGG |
| 9 | 135 | 135 | ATKRYCTSPSCHGLWYFNL |
| 9 | 136 | 136 | GCGACCAAGAGATATTGTACTAGTCCCAGCTGCCATGGACTCTGGTACTTCAATCTC |
| 9 | 137 | 137 | GAAACGACACTCACGCAGTCTCCAATCTCCCTGTCCGTCACCCCTGGAGAGCCGGCCTCCATCTCCTGCAGGTCTAGTAAGAGCCTCTTGGATAGTGATGATGGAAACACTTATTTGGACTGGTACCTGCAGAAGCCAGGGCAGTCTCCACAGATCCTGATCTATATGCTTTCGTATCGGGCCTCTGGAGTCCCAGACAGGTTCAGTGGCAGTGGGTCAGGCACTGATTTCACACTGAAAATCAGCAGGGTGGAGGCTGAGGATGTTGGAGTTTATTACTGCATGCAACGTATAGAGTATCCTTACACTTTTGGCCAGGGGACCAAGGTGGAGATCAAA |
| 9 | 138 | 138 | ETTLTQSPISLSVTPGEPASISCRSSKSLLDSDDGNTYLDWYLQKPGQSPQILIYMLSYRASGVPDRFSGSGSGTDFTLKISRVEAEDVGVYYCMQRIEYPYTFGQGTKVEIK |
| 9 | 139 | 139 | RSSKSLLDSDDGNTYLD |

TABLE 6-continued

Informal Sequence Listing

| Antibody No. | Seq. Ref. No. | SEQ ID NO. | Sequence |
|---|---|---|---|
| 9 | 140 | 140 | AGGTCTAGTAAGAGCCTCTTGGATAGTGATGATGGAAACACTTATTTGGAC |
| 9 | 141 | 141 | MLSYRAS |
| 9 | 142 | 142 | ATGCTTTCGTATCGGGCCTCT |
| 9 | 143 | 143 | MQRIEYPYT |
| 9 | 144 | 144 | ATGCAACGTATAGAGTATCCTTACACT |
| 10 | 145 | 145 | CAGGTGCAGCTGGTGCAATCTGGGGCTGAGATGAAGAAGCCTGGGTCCTCGGTGACAGTCTCCTGCAAGGCTTCTGGAGTCCCCTTCACCAGTTATACCTACAGCTGGGTGCGACAGGCCCCTGGACAAGGGCTTGAGTGGATGGGAAGGGTCCTCCCTGTCATAGGTTCGGCAAAGTACCCACAGAAGTTCCAGGGCACAGTCACCATTACCGCGGACAAATCCACGAGCACAATATATTTGCAACTGAGCAGCCTAAGACCTGAAGCACGGCCATTTATTTCTGTGCGGGAAGTCTACTGGCTGGGTACGACAGGGAATTTGACTCCTGGGGCCAGGGAACCCTGGTCACCGTCTCCTCA |
| 10 | 146 | 146 | QVQLVQSGAEMKKPGSSVTVSCKASGVPFTSYTYSWVRQAPGQGLEWMGRVLPVIGSAKYPQKFQGTVTITADKSTSTIYLQLSSLRPEDTAIYFCAGSLLAGYDREFDSWGQGTLVTVSS |
| 10 | 147 | 147 | VPFTSYTYS |
| 10 | 148 | 148 | GTCCCCTTCACCAGTTATACCTACAGC |
| 10 | 149 | 149 | RVLPVIGSAKYPQKFQG |
| 10 | 150 | 150 | AGGGTCCTCCCTGTCATAGGTTCGGCAAAGTACCCACAGAAGTTCCAGGGC |
| 10 | 151 | 151 | AGSLLAGYDREFDS |
| 10 | 152 | 152 | GCGGGAAGTCTACTGGCTGGGTACGACAGGGAATTTGACTCC |
| 10 | 153 | 153 | GACATCCAGATGACCCAGTCTCCATCCTCACTGTCTGCATCTGTGGGAGACAGAATCACCATCACTTGTCGGGCGAGTCAGGGTATTAGCAACTGGTTAGCCTGGTATCAGCAGAAGCAGGGAAAGCCCCTAAGTCCCTGATCTATGAAGCATCCACTTTGCAAAGTGGGGTTTCATCAAGGTTCAGCGGCAGTGGATCTGGGACACACTTCACTCTCACCATCGCCAGCCTGCAGCCTGAAGATTTTGCAACTTATTACTGCCAACAGTATTATATTTACCCGCTCACTTTCGGCGGAGGGACCAAGCTGGAGATCAAA |
| 10 | 154 | 154 | DIQMTQSPSSLSASVGDRITITCRASQGISNWLAWYQQKPGKAPKSLIYEASTLQSGVSSRFSGSGSGTHFTLTIASLQPEDFATYYCQQYYIYPLTFGGGTKLEIK |
| 10 | 155 | 155 | RASQGISNWLA |
| 10 | 156 | 156 | CGGGCGAGTCAGGGTATTAGCAACTGGTTAGCC |
| 10 | 157 | 157 | EASTLQS |
| 10 | 158 | 158 | GAAGCATCCACTTTGCAAAGT |
| 10 | 159 | 159 | QQYYIYPLT |
| 10 | 160 | 160 | CAACAGTATTATATTTACCCGCTCACT |
| 11 | 161 | 161 | GAGGTGCAGCTGGTGGAGTCTGGGGGAGGCTTGGTCAAGCCTGGAGGGTCCCTAAGGCTCTCCTGTGCAGCCTCTGGAAGCTCCTTCCGTTATTCCTACATGAGTTGGGTCCGCCAGGCTCCAGGGAAGGGGCTGCAGTGGGTTGCATCTATTAGTCCTAGTAGCACTTATACAGACTACGCAGACTCTGTGAAGGGCCGAAGCACCATCTCCAGAGACCACGACAAGATCTCTCTGCAAGTGAACAGCCTGAGAGGCGACGACACGGCCGTGTATTATTGTGTGAGACATATGAATTTGGTGATGGGCCGTTCGCCTTTGATATCTGGGGCCGCGGGACAATGGTCACCGTCTCTTCA |
| 11 | 162 | 162 | EVQLVESGGGLVKPGGSLRLSCAASGSSFRYSYMSWVRQAPGKGLQWVASISPSSTYTDYADSVKGRSTISRDHDKISLQVNSLRGDDTAVYYCVRHMNLVMGPFAFDIWGRGTMVTVSS |

TABLE 6-continued

Informal Sequence Listing

| Antibody Ref. No. | Seq. Ref. No. | SEQ ID NO. | Sequence |
|---|---|---|---|
| 11 | 163 | 163 | SSFRYSYMS |
| 11 | 164 | 164 | AGCTCCTTCCGTTATTCCTACATGAGT |
| 11 | 165 | 165 | SISPSSTYTDYADSVKG |
| 11 | 166 | 166 | TCTATTAGTCCTAGTAGCACTTATACAGACTACGCAGACTCTGTGAAGGGC |
| 11 | 167 | 167 | VRHMNLVMGPFAFDI |
| 11 | 168 | 168 | GTGAGACATATGAATTTGGTGATGGGGCCGTTCGCCTTTGATATC |
| 11 | 169 | 169 | CAGTCTGTCGTGACGCAGCCGCCCTCATTGTCTGGGGCCCCAGGGCAGAGGATCACCATTTCGTGCACTGGGAGCAGCTCCAACATCGGGGCAGGTTATGATGTAAACTGGTACCAGCAGCTTCCAGGAACAGCCCCCAAACTCCTCATCTATGCTAAGACCAATCGGCCCTCAGGGGTCCCTGAGCGCTTCTCTGGTTCCGAGTCTGGCACCTCCGCCTCCCTGGCCATCACTGGGCTCCAGCCTGAGGATGAGGCTGATTATTACTGCCAGTCATATGACAGGATCGGAATGTATGTCTTCGGAACTGGGACCAAGCTGACCGTCCTA |
| 11 | 170 | 170 | QSVVTQPPSLSGAPGQRITISCTGSSSNIGAGYDVNWYQQLPGTAPKLLIYAKTNRPSGVPERFSGSESGTSASLAITGLQPEDEADYYCQSYDRIGMYVFGTGTKLTVL |
| 11 | 171 | 171 | TGSSSNIGAGYDVN |
| 11 | 172 | 172 | ACTGGGAGCAGCTCCAACATCGGGGCAGGTTATGATGTAAAC |
| 11 | 173 | 173 | AKTNRPS |
| 11 | 174 | 174 | GCTAAGACCAATCGGCCCTCA |
| 11 | 175 | 175 | QSYDRIGMYV |
| 11 | 176 | 176 | CAGTCATATGACAGGATCGGAATGTATGTC |
| 12 | 177 | 177 | GAGGTGCAGCTGGTGGAGTCTGGGGGAGACTTGGTAAAGCCTGGGGGGTCCCTCAGACTCTCATGTGAAGGCTCTGGCTTCATTTTTCCGAACGCCTGGATGAGCTGGGTCCGCCAGGCTCCAGGGAAGGGGCTGGAGTGGGTTGGCCGTATTAAAAGCAACACTGACGGTGGGACAACAGACTACGGTGCACCCGTGAAAGGCAGATTCACCATCTCAAGAGATGATTCAACAAACACGATGTATCTGCACATGAACAGCCTGAAGACCGAGGACACAGCCGTGTATTTCTGTTCCACAGGCCCACCCTATAAGTATTTTGATGAGACTGGTTATTCGGTCGTTGACTACTGGGGCCAGGGAACCCTGGTCACCGTCTCCTCA |
| 12 | 178 | 178 | EVQLVESGGDLVKPGGSLRLSCEGSGFIFPNAWMSWVRQAPGKGLEWVGRIKSNTDGGTTDYGAPVKGRFTISRDDSTNTMYLHMNSLKTEDTAVYFCSTGPPYKYFDETGYSVVDYWGQGTLVTVSS |
| 12 | 179 | 179 | FIFPNAWMS |
| 12 | 180 | 180 | TTCATTTTTCCGAACGCCTGGATGAGC |
| 12 | 181 | 181 | RIKSNTDGGTTDYGAPVKG |
| 12 | 182 | 182 | CGTATTAAAAGCAACACTGACGGTGGGACAACAGACTACGGTGCACCCGTGAAAGGC |
| 12 | 183 | 183 | STGPPYKYFDETGYSVVDY |
| 12 | 184 | 184 | TCCACAGGCCCACCCTATAAGTATTTTGATGAGACTGGTTATTCGGTCGTTGACTAC |
| 12 | 185 | 185 | TCCTATGAGCTGACACAGCCACCCTCAGCGTCTGGGACCCCCGGGCAGAGGGTCATCATCTCTTGTTCTGGAAGCACGTCCAATTCCGGATATAATTATTTTTACTGGTATCAGCAGCGCCCAGGAACGGCCCCCAAACTCCTCATCTATGGCAGTGATCAGCGGCCCTCAGGGGTCCCTGACCGATTCTCTGGTTCCCAGTCTGGCCCCTCAGCCTCCCTGGCCATCAGTGGGCTCCGGTCCGAGGATGAGGCTCATTATTACTGCGCAGTGGGATGACAACCTGAGTGGTCCGGTGTTCGGCGGAGGGACCAAGCTCACCGTCCTA |

TABLE 6-continued

Informal Sequence Listing

| Antibody No. | Seq. Ref. No. | SEQ ID NO. | Sequence |
|---|---|---|---|
| 12 | 186 | 186 | SYELTQPPSASGTPGQRVIISCSGSTSNSGYNYFYWYQQRPGTAPKLLIYG SDQRPSGVPDRFSGSQSGPSASLAISGLRSEDEAHYYCAAWDDNLSGPVF GGGTKLTVL |
| 12 | 187 | 187 | SGSTSNSGYNYFY |
| 12 | 188 | 188 | TCTGGAAGCACGTCCAATTCCGGATATAATTATTTTTAC |
| 12 | 189 | 189 | GSDQRPS |
| 12 | 190 | 190 | GGCAGTGATCAGCGGCCCTCA |
| 12 | 191 | 191 | AAWDDNLSGPV |
| 12 | 192 | 192 | GCAGCGTGGGATGACAACCTGAGTGGTCCGGTG |
| 13 | 193 | 193 | CAGGTCCAGCTTGTACAGTCTGGGGGAGGCTTGGTAAAGCCTGGGGG GTCCCGAAGACTCGCATGTGCAGCCTCTGGATTCATCTTCCGCAACGC CTGGATGAGCTGGGTCCGCCAGGCTCCAGGGAAGGGGCTGGAGTGGG TTGGCCGGATTAAAAGGACAAGTGAAGGAGGGTCAGTCGACTACGCG ACACCCGTGCAAGGCAGATTCTCCATCTCAAGAGATGATTCTAGAAA CACACTGTATCTACAAATGCACAGCCTGGCACCCGACGACACAGCCG TGTATTACTGTTCCACAGGCCCACCCTATTCTTACTTTGATAGTACTG GTTATTCGGTCGTGGACTACTGGGGCCAGGGAACCCTGGTCACCGTCT CTTCA |
| 13 | 194 | 194 | QVQLVQSGGGLVKPGGSRRLACAASGFIFRNAWMSWVRQAPGKGLEW VGRIKRTSEGGSVDYATPVQGRFSISRDDSRNTLYLQMHSLAPDDTAVY YCSTGPPYSYFDSTGYSVVDYWGQGTLVTVSS |
| 13 | 195 | 195 | FIFRNAWMS |
| 13 | 196 | 196 | TTCATCTTCCGCAACGCCTGGATGAGC |
| 13 | 197 | 197 | RIKRTSEGGSVDYATPVQG |
| 13 | 198 | 198 | CGGATTAAAAGGACAAGTGAAGGAGGGTCAGTCGACTACGCGACAC CCGTGCAAGGC |
| 13 | 199 | 199 | STGPPYSYFDSTGYSVVDY |
| 13 | 200 | 200 | TCCACAGGCCCACCCTATTCTTACTTTGATAGTACTGGTTATTCGGTC GTGGACTAC |
| 13 | 201 | 201 | CAGTCTGTGTTGACGCAGCCGCCCTCAGCGTCTGGGACCCCCGGGCA GAGGGTCACCATCTCTTGTTCTGCAAGCAGCTCCAACATCGGAGATA ATTATTTCTACTGGTACCAACAACTCCCAGGAAAGGCCCCCACACTCC TCATGTATGGTAGTGACCAGCGGTCCTCAGGGGTCCCTGACCGATTCT CTGGCTCCCAGTCTGGCACCTCTGCCTCCTGGCCATCAGTGGGCTCC GGTCCGAGGATGAAGCTGCTTATTATTGTGCAGCTTGGGATGACAGC CTGAGTGGTCCGGTGTTCGGCGGAGGCACCCAGCTGACCGTCCTC |
| 13 | 202 | 202 | QSVLTQPPSASGTPGQRVTISCSASSSNIGDNYFYWYQQLPGKAPTLLMY GSDQRSSGVPDRFSGSQSGTSASLAISGLRSEDEAAYYCAAWDDSLSGPV FGGGTQLTVL |
| 13 | 203 | 203 | SASSSNIGDNYFY |
| 13 | 204 | 204 | TCTGCAAGCAGCTCCAACATCGGAGATAATTATTTCTAC |
| 13 | 205 | 205 | GSDQRSS |
| 13 | 206 | 206 | GGTAGTGACCAGCGGTCCTCA |
| 13 | 207 | 207 | AAWDDSLSGPV |
| 13 | 208 | 208 | GCAGCTTGGGATGACAGCCTGAGTGGTCCGGTG |
| 14 | 209 | 209 | GAGGTGCAGCTGGTGGAGTCTGGGGCTGAGGTGAGGAAGCCTGGGG CCTCAGTGAAGGTCTCCTGCAAGGCTTCTGGATACATCTTCATTAACT ACTATATACACTGGGTGCGACAGGCCCCTGGACAAGGTCTTGAGTGG ATGGGGTGGATCAACCCTAACAGTGGAGCCTCAAACCACGCACAGAC GTTCGAGGGCAGGATCACCATGACCACCGACACGTCCAGCAACACAG |

TABLE 6-continued

Informal Sequence Listing

| Antibody Ref. No. | Seq. Ref. No. | SEQ ID NO. | Sequence |
|---|---|---|---|
| | | | CCTACATGGAGCTGAGTAGACTGAGAGAGGACGACACGGCCGTCTAT TACTGTGCGAGATCCCAGCAACTGCTCGTTATCACCGATTACTCCTTA GACTACTGGGGCCTGGGAACCCTGGTCACCGTCTCCTCA |
| 14 | 210 | 210 | EVQLVESGAEVRKPGASVKVSCKASGYIFINYYIHWVRQAPGQGLEWM GWINPNSGASNHAQTFEGRITMTTDTSSNTAYMELSRLREDDTAVYYCA RSQQLLVITDYSLDYWGLGTLVTVSS |
| 14 | 211 | 211 | YIFINYYIH |
| 14 | 212 | 212 | TACATCTTCATTAACTACTATATACAC |
| 14 | 213 | 213 | WINPNSGASNHAQTFEG |
| 14 | 214 | 214 | TGGATCAACCCTAACAGTGGAGCCTCAAACCACGCACAGACGTTCGA GGGC |
| 14 | 215 | 215 | ARSQQLLVITDYSLDY |
| 14 | 216 | 216 | GCGAGATCCCAGCAACTGCTCGTTATCACCGATTACTCCTTAGACTAC |
| 14 | 217 | 217 | TCCTCTGAGCTGACTCAGGACCCTGCTGTGTCTGTGGCCTTGGGACAG ACAGTCAGGATCACATGCCACGGAGACACCCTCAGAAACTATTATCC AGCCTGGTACCAGCAGAAGCCAGGACAGGCCCCTGTTCTTGTCGTGT CTGATAGAAACACCCGGCCCTCAGGGATCCCAGACCGATTCTCTGTCT CCACCTCAGGAAACACAGCTTCCTTGACCATCACTGGGGCTCAGGCG GAAGATGAGGGTGACTATTACTGTAACTGCCGCGACAGCAGTGGTCA CCGGCTGGTCTTCGGCGGAGGGACCAAGCTGACCGTCCTA |
| 14 | 218 | 218 | SSELTQDPAVSVALGQTVRITCHGDTLRNYYPAWYQQKPGQAPVLVVS DRNTRPSGIPDRFSVSTSGNTASLTITGAQAEDEGDYYCNCRDSSGHRLV FGGGTKLTVL |
| 14 | 219 | 219 | HGDTLRNYYPA |
| 14 | 220 | 220 | CACGGAGACACCCTCAGAAACTATTATCCAGCC |
| 14 | 221 | 221 | DRNTRPS |
| 14 | 222 | 222 | GATAGAAACACCCGGCCCTCA |
| 14 | 223 | 223 | NCRDSSGHRLV |
| 14 | 224 | 224 | AACTGCCGCGACAGCAGTGGTCACCGGCTGGTC |
| 15 | 225 | 225 | CAGGTCCAGCTTGTGCAGTCTGGGGCTGAGGTGAAGAAGCCTGGGTC CTCGGTGAAGGTCTCCTGCGAGGCTTCTGGAGACACCTTCACCAGTTA TGCAGTCATCTGGGTGCGCCAGGCCCCAGGACAAGGGCTTGAGTGGA TGGGAAGTATCATCCCTATCTTTCAAACAATCAACTACGCACCAAAGT TCCAGGGGAGGGTCACCCTAAGCGCGGACGGATCTACGAGAACAGTC TACATGGAGTTGGGAAGCCTGAGATCAGAGGACACGGCCATATATTT CTGTGCGACCAAGAGATACTGTACTAGTCCCAGCTGCCATGGACTCT GGTACTTCAATCTCTGGGGCCGTGGAACCCTGGTCACCGTCTCCTCA |
| 15 | 226 | 226 | QVQLVQSGAEVKKPGSSVKVSCEASGDTFTSYAVIWVRQAPGQGLEWM GSIIPIFQTINYAPKFQGRVTLSADGSTRTVYMELGSLRSEDTAIYFCATKR YCTSPSCHGLWYFNLWGRGTLVTVSS |
| 15 | 227 | 227 | DTFTSYAVI |
| 15 | 228 | 228 | GACACCTTCACCAGTTATGCAGTCATC |
| 15 | 229 | 229 | SIIPIFQTINYAPKFQG |
| 15 | 230 | 230 | AGTATCATCCCTATCTTTCAAACAATCAACTACGCACCAAAGTTCCAG GGG |
| 15 | 231 | 231 | ATKRYCTSPSCHGLWYFNL |
| 15 | 232 | 232 | GCGACCAAGAGATACTGTACTAGTCCCAGCTGCCATGGACTCTGGTA CTTCAATCTC |
| 15 | 233 | 233 | GATATTGTGATGACCCAGTCTCCACTCTCCCTGCCCGTCACCCCTGGA GAGCCGGCCTCCATCTCCTGCAGGTCTAGTAAGAGCCTCTTGGATAGT |

TABLE 6-continued

Informal Sequence Listing

| Antibody Ref. No. | Seq. Ref. No. | SEQ ID NO. | Sequence |
|---|---|---|---|
| | | | GATGATGGAAACACCTATTTGGACTGGTACCTGCAGAAGCCAGGGCA GTCTCCACAGATCCTGATCTATATGCTTTCGCATCGGGCCTCTGGAGT CCCAGACAGGTTCAGTGGCAGTGGGTCAGGCACTGACTTCACACTGA AAATCAGTAGGGTGGAGGCTGAGGATGTTGGAGTTTATTACTGCATG CAACGTGTAGAGTATCCTTACAGTTTTGGCCAGGGGACCAAGGTGGA GATCAAA |
| 15 | 234 | 234 | DIVMTQSPLSLPVTPGEPASISCRSSKSLLDSDDGNTYLDWYLQKPGQSP QILIYMLSHRASGVPDRFSGSGSGTDFTLKISRVEAEDVGVYYCMQRVEY PYSFGQGTKVEIK |
| 15 | 235 | 235 | RSSKSLLDSDDGNTYLD |
| 15 | 236 | 236 | AGGTCTAGTAAGAGCCTCTTGGATAGTGATGATGGAAACACCTATTT GGAC |
| 15 | 237 | 237 | MLSHRAS |
| 15 | 238 | 238 | ATGCTTTCGCATCGGGCCTCT |
| 15 | 239 | 239 | MQRVEYPYS |
| 15 | 240 | 240 | ATGCAACGTGTAGAGTATCCTTACAGT |
| 16 | 241 | 241 | CAGATCACCTTGAAGGAGTCTGGGCCTACCGTGGTGAAACCCACACA GACCCTCACACTGACCTGCACCTTCTCTGGGTTCTCACTCAACACTCG TGGCATGGGTGTGGCCTGGATCCGTCAGCCCCCAGGAGGGGCCCTGG AGTGGCTTGCACTCGTTGATTGGGATGATGATAAGCGCTACAGCCCTT CTCTGAGGAGCAGGCTCACCATCACCAAAGACACGTCCAAGAACCAG GTGCTCTTTACAATGACCACCATGGACCCCGCGGACACAGCCACGTA CTACTGTGCACACATCGGTCTTTATGATCGTGGTGGCTATTACTTATT CTACTTTGACTTTTGGGGCCAGGGAACCCTGGTCACCGTCTCCTCA |
| 16 | 242 | 242 | QITLKESGPTVVKPTQTLTLTCTFSGFSLNTRGMGVAWIRQPPGGALEWL ALVDWDDDKRYSPSLRSRLTITKDTSKNQVLFTMTTMDPADTATYYCA HIGLYDRGGYYLFYFDFWGQGTLVTSS |
| 16 | 243 | 243 | FSLNTRGMGVA |
| 16 | 244 | 244 | TTCTCACTCAACACTCGTGGCATGGGTGTGGCC |
| 16 | 245 | 245 | LVDWDDDKRYSPSLRS |
| 16 | 246 | 246 | CTCGTTGATTGGGATGATGATAAGCGCTACAGCCCTTCTCTGAGGAGC |
| 16 | 247 | 247 | AHIGLYDRGGYYLFYFDF |
| 16 | 248 | 248 | GCACACATCGGTCTTTATGATCGTGGTGGCTATTACTTATTCTACTTTG ACTTT |
| 16 | 249 | 249 | GATATTGTGCTGACGCAGTCTCCATCCTCCCTGTCTGCGTCTGTAGGC GACAGGGTCACCATCACTTGCCGGGCAAGTCAGAGCATTGCCAGCTA TGTGAATTGGTTTCAGCAGAAACCAGGGAAAGCCCCTGTCCTCTTGAT GTTTGCTTCATCCATTTTGCAAAGTGGCGTCCCGCCAAGGTTCCGTGG CAGTGGATCTGGGACAGATTTCACTCTCACCATCACCAGTCTCCAGCC TGAAGATTTTGCAACTTACTACTGTCAACACACTTACACCACCCCGTA CATTTTTGGCCGGGGGACCAAAGTGGAGATCAAA |
| 16 | 250 | 250 | DIVLTQSPSSLSASVGDRVTITCRASQSIASYVNWFQQKPGKAPVLLMFA SSILQSGVPPRFRGSGSGTDFTLTITSLQPEDFATYYCQHTYTTPYIFGRGT KVEIK |
| 16 | 251 | 251 | RASQSIASYVN |
| 16 | 252 | 252 | CGGGCAAGTCAGAGCATTGCCAGCTATGTGAAT |
| 16 | 253 | 253 | ASSILQS |
| 16 | 254 | 254 | GCTTCATCCATTTTGCAAAGT |
| 16 | 255 | 255 | QHTYTTPYI |
| 16 | 256 | 256 | CAACACACTTACACCACCCCGTACATT |

TABLE 6-continued

Informal Sequence Listing

| Antibody No. | Seq. Ref. No. | SEQ ID NO. | Sequence |
|---|---|---|---|
| 17 | 257 | 257 | CAGGTCCAGCTTGTGCAGTCTGGTCCTACGCTGGTGAAACCCACACA<br>GACCCTCACGCTGACCTGCACCTTCTCTGGCTTCTCACTCAGCACTCG<br>TGGAGTGGGTGTGGGCTGGATCCGTCAGCCCCCAGGAAAGGCCCTGG<br>AGTGCCTTGGATTCACTTATTGGGATGGTGATCAGTTCCACAGCCCAT<br>CTCTGAAGAACAGACTCACCATTACCAAGGACACCTCCAAAAACCAG<br>GTGGTCCTTAGAATGACCAACATGGACCCTGTGGACACGGCCACCTA<br>TTTCTGTGTACACAGCGATCTCTATGATAGTGGTGGTTATTACTTGTA<br>CTACTTTGACTACTGGGGCCAGGGAACCCTGGTCACCGTCTCCTCA |
| 17 | 258 | 258 | QVQLVQSGPTLVKPTQTLTLTCTFSGFSLSTRGVGVGWIRQPPGKALECL<br>GFTYWDGDQFHSPSLKNRLTITKDTSKNQVVLRMTNMDPVDTATYFCV<br>HSDLYDSGGYYLYYFDYWGQGTLVTVSS |
| 17 | 259 | 259 | FSLSTRGVGVG |
| 17 | 260 | 260 | TTCTCACTCAGCACTCGTGGAGTGGGTGTGGGC |
| 17 | 261 | 261 | FTYWDGDQFHSPSLKN |
| 17 | 262 | 262 | TTCACTTATTGGGATGGTGATCAGTTCCACAGCCCATCTCTGAAGAAC |
| 17 | 263 | 263 | VHSDLYDSGGYYLYYFDY |
| 17 | 264 | 264 | GTACACAGCGATCTCTATGATAGTGGTGGTTATTACTTGTACTACTTT<br>GACTAC |
| 17 | 265 | 265 | GACATCCAGATGACCCAGTCTCCATCCTCCCTGTCTGCTTCTGTGGGG<br>GACAGAGTCACCATCACTTGCCGAGCCAGTCAGACCATTGCCAGTTA<br>TTTAAATTGGTATCAGCAAAGACCAGGGGAAGCCCCTAAACTCTTGA<br>TCTATGCTGCTTCCAGTTTGCAGAGTGGGGTCTCATCAAGATTCAGTG<br>GCAGGGGATCTGGGACAGATTTCACTCTCACCATCAATATTCTACAAC<br>CTGAGGATCTTGCAACTTACTTCTGTCAACAGGCTTACTCTGCCCCGT<br>ACACTTTTGGCCAGGGGACCAAGGTGGAAATCAAA |
| 17 | 266 | 266 | DIQMTQSPSSLSASVGDRVTITCRASQTIASYLNWYQQRPGEAPKLLIYA<br>ASSLQSGVSSRFSGRGSGTDFTLTINILQPEDLATYFCQQAYSAPYTFGQG<br>TKVEIK |
| 17 | 267 | 267 | RASQTIASYLN |
| 17 | 268 | 268 | CGAGCCAGTCAGACCATTGCCAGTTATTTAAAT |
| 17 | 269 | 269 | AASSLQS |
| 17 | 270 | 270 | GCTGCTTCCAGTTTGCAGAGT |
| 17 | 271 | 271 | QQAYSAPYT |
| 17 | 272 | 272 | CAACAGGCTTACTCTGCCCCGTACACT |
| 18 | 273 | 273 | CAGGTCCAGCTGGTACAGTCTGGAGCTGAGGTGAAGAAGCCTGGGGC<br>CTCAGTGAAGGTCTCCTGCAAGGCTTCTGGTTACACCTTTACCAGCTA<br>TGGTACCAGCTGGGTGCGACAGGCCCCTGGACAAGGGCTTGAGTGGA<br>TGGGATGGATCAGCGCTTACAATGGTAACACAAACTATGCACAGAAT<br>CTCCAGGGCAGAGTCACCATGACCACAGACACATCAACGAGCACATC<br>CTACATGGAGCTGAGGAGCCTGAGATCTGACGACACGGCCGTGTATT<br>ACTGTGCGAGAGATGTCCCCGTCATAGCAGCTGGTACAATGGACTAC<br>TGGGGCCAGGGAACCCTGGTCACCGTCTCCTCA |
| 18 | 274 | 274 | QVQLVQSGAEVKKPGASVKVSCKASGYTFTSYGTSWVRQAPGQGLEW<br>MGWISAYNGNTNYAQNLQGRVTMTTDTSTSTSYMELRSLRSDDTAVYY<br>CARDVPVIAAGTMDYWGQGTLVTVSS |
| 18 | 275 | 275 | YTFTSYGTS |
| 18 | 276 | 276 | TACACCTTTACCAGCTATGGTACCAGC |
| 18 | 277 | 277 | WISAYNGNTNYAQNLQG |
| 18 | 278 | 278 | TGGATCAGCGCTTACAATGGTAACACAAACTATGCACAGAATCTCCA<br>GGGC |
| 18 | 279 | 279 | ARDVPVIAAGTMDY |

TABLE 6-continued

Informal Sequence Listing

| Antibody No. | Seq. Ref. No. | SEQ ID NO. | Sequence |
|---|---|---|---|
| 18 | 280 | 280 | GCGAGAGATGTCCCCGTCATAGCAGCTGGTACAATGGACTAC |
| 18 | 281 | 281 | GATATTGTGATGACCCAGACTCCACTCTCCCTGCCCGTCACCCTTGGA CAGCCGGCCTCCATCTCCTGCAGGTCTAGTCAAAGCCTCGTATACAGT GATGGAAACACCTACTTGAATTGGTTTCAGCAGAGGCCAGGCCAATC TCCAAGGCGCCTAATTTATAAGGTTTCTAATCGGGACTCTGGGGTCCC AGACAGATTCAGCGGCAGTGGGTCAGGCACTGATTTCACACTGAAAA TCAGCAGGGTGGAGGCTGAGGATGTTGGGGTTTATTACTGCATGCAA GGTCCACACTGGCCTCGAACGTTCGGCCAAGGGACCAAGGTGGAAAT CAAA |
| 18 | 282 | 282 | DIVMTQTPLSLPVTLGQPASISCRSSQSLVYSDGNTYLNWFQQRPGQSPR RLIYKVSNRDSGVPDRFSGSGSGTDFTLKISRVEAEDVGVYYCMQGPHW PRTFGQGTKVEIK |
| 18 | 283 | 283 | RSSQSLVYSDGNTYLN |
| 18 | 284 | 284 | AGGTCTAGTCAAAGCCTCGTATACAGTGATGGAAACACCTACTTGAAT |
| 18 | 285 | 285 | KVSNRDS |
| 18 | 286 | 286 | AAGGTTTCTAATCGGGACTCT |
| 18 | 287 | 287 | MQGPHWPRT |
| 18 | 288 | 288 | ATGCAAGGTCCACACTGGCCTCGAACG |
| 19 | 289 | 289 | CAGGTCCAGCTTGTGCAGTCTGGGGCTGAGGTGAAGAAGCCTGGGGC CTCAGTGAAAGTCTCGTGTGAGGCCTCTGAATACAGTTTCAGTGGCG ACTATGTTCACTGGGTGCGACAGGCCCCTGGACAAGGGCTTGAGTGG ATGGGTTGGATAAAGGCTGTCAATGGTGGCGCGAACTACGCACAGAA GTTTCACGGCAGGGTCACAATGACCACTGACTCGTCCAAGAGCACAG TCTATTTGGAGATGAGCAGACTGACACCTGCCGACACGGCCATTTATT TTTGTGCGAAGGATCGGGCTGCAAGTGTTCATGTGCCAGCGGGCGCG TTTGACCTCTGGGGCCAGGGAACCCTGGTCACCGTCTCCTCA |
| 19 | 290 | 290 | QVQLVQSGAEVKKPGASVKVSCEASEYSFSGDYVHWVRQAPGQGLEW MGWIKAVNGGANYAQKFHGRVTMTTDSSKSTVYLEMSRLTPADTAIYF CAKDRAASVHVPAGAFDLWGQGTLVTVSS |
| 19 | 291 | 291 | YSFSGDYVH |
| 19 | 292 | 292 | TACAGTTTCAGTGGCGACTATGTTCAC |
| 19 | 293 | 293 | WIKAVNGGANYAQKFHG |
| 19 | 294 | 294 | TGGATAAAGGCTGTCAATGGTGGCGCGAACTACGCACAGAAGTTTCA CGGC |
| 19 | 295 | 295 | AKDRAASVHVPAGAFDL |
| 19 | 296 | 296 | GCGAAGGATCGGGCTGCAAGTGTTCATGTGCCAGCGGGCGCGTTTGA CCTC |
| 19 | 297 | 297 | GACATCCAGATGACCCAGTCTCCTTCCTCCCTGTCTGCATATGTAGGA GACAGAGTCAGCATCACTTGTCGGGCAAGTCAGAGCATTGACAACTT TTTAAATTGGTATCGGCAGAGACCAGGGAAAGCCCCTGAACTCCTAA TCTATGCTGCCTCCACTTTGCAAGGTGGGGTCCCATCAAGGTTCAGTG GCAGTGGATCTGGGACACATTTCACTCTCACCATCAGCAGTCTCCAGC CTGAAGATTTTGCCACTTACTACTGTCAACAGAGTTTCACTATTCCTT CGATCACCTTCGGCCAAGGGACACGACTGGAGATTAAA |
| 19 | 298 | 298 | DIQMTQSPSSLSAYVGDRVSITCRASQSIDNFLNWYRQRPGKAPELLIYA ASTLQGGVPSRFSGSGSGTHFTLTISSLQPEDFATYYCQQSFTIPSITFGQG TRLEIK |
| 19 | 299 | 299 | RASQSIDNFLN |
| 19 | 300 | 300 | CGGGCAAGTCAGAGCATTGACAACTTTTTAAAT |
| 19 | 301 | 301 | AASTLQG |
| 19 | 302 | 302 | GCTGCCTCCACTTTGCAAGGT |

TABLE 6-continued

Informal Sequence Listing

| Antibody No. | Seq. Ref. No. | SEQ ID NO. | Sequence |
|---|---|---|---|
| 19 | 303 | 303 | QQSFTIPSIT |
| 19 | 304 | 304 | CAACAGAGTTTCACTATTCCTTCGATCACC |
| 20 | 305 | 305 | CAGGTCACCTTGAAGGAGTCTGGTCCTGCGCTGGTGAGACCCAAACA GACCCTCACTCTGACCTGCTCCTTCTCCGGCTTCTCACTCGACACTCA AGAACGGGTGTGAATTGGATCCGTCAGTCCCCAGGGAAGGCCCTGG AGTGGCTTGCACGGATTGATTGGGATGGCAATATTTACTCCAGCACCT CTGTGAGGACCAAACTCAGCATCTCCAAGGGCACCTCCAAAAACCAG GTGGTCCTTACAATGACCGACGTGGACCCTGTGGACACAGCCACCTA TTACTGTGCACGGACTCTTTACTATACTTCTGGTGGTTATTACTTGAAC CTCTTTGACTACTGGGGCCAAGGAACCCTGGTCACCGTCTCCTCA |
| 20 | 306 | 306 | QVTLKESGPALVRPKQTLTLTCSFSGFSLDTQRTGVNWIRQSPGKALEWL ARIDWDGNIYSSTSVRTKLSISKGTSKNQVVLTMTDVDPVDTATYYCAR TLYYTSGGYYLNLFDYWGQGTLVTVSS |
| 20 | 307 | 307 | FSLDTQRTGVN |
| 20 | 308 | 308 | TTCTCACTCGACACTCAAAGAACGGGTGTGAAT |
| 20 | 309 | 309 | RIDWDGNIYSSTSVRT |
| 20 | 310 | 310 | CGGATTGATTGGGATGGCAATATTTACTCCAGCACCTCTGTGAGGACC |
| 20 | 311 | 311 | ARTLYYTSGGYYLNLFDY |
| 20 | 312 | 312 | GCACGGACTCTTTACTATACTTCTGGTGGTTATTACTTGAACCTCTTTG ACTAC |
| 20 | 313 | 313 | GAAATTGTAATGACACAGTCTCCACCCTCCCTGTCTGCCTCTGTTGGG GACAGAGTCACCATCACTTGCCGGGCAAGTCAGACAATTCCCAGCTA TGTCAATTGGTATCAGCAGATATCAGGGAAAGCCCCTCGCCTCCTGAT CTATGCTGCCTCACTTTTGCAAAGTGGGGTCCCATCAAGGTTCAGTGG CAGCGGATCTGGGACAGAGTTCAGTCTCACCATCAGCGGTCTGCGAC CTGAGGATTTTGGCACTTACTACTGTCAACAGAGTTACAGTTCCACTC CCACTTTCGGCCAGGGGACCAAGGTGGAAATCAAA |
| 20 | 314 | 314 | EIVMTQSPPSLSASVGDRVTITCRASQTIPSYVNWYQQISGKAPRLLIYAA SLLQSGVPSRFSGSGSGTEFSLTISGLRPEDFGTYYCQQSYSSTPTFGQGT KVEIK |
| 20 | 315 | 315 | RASQTIPSYVN |
| 20 | 316 | 316 | CGGGCAAGTCAGACAATTCCCAGCTATGTCAAT |
| 20 | 317 | 317 | AASLLQS |
| 20 | 318 | 318 | GCTGCCTCACTTTTGCAAAGT |
| 20 | 319 | 319 | QQSYSSTPT |
| 20 | 320 | 320 | CAACAGAGTTACAGTTCCACTCCCACT |
| 21 | 321 | 321 | CAGGTGCAGCTGGTGGAGTCTGGGGGAGGCTTGGTAAAGCCTGGGGG GTCCCTGAGACTCTCATGTGCAGCCTCTGGATTCATTTTCAGTAACGC CTGGATGAGTTGGGTCCGCCAGTCTCCAGGGAAGGGGCTGGAGTGGG TTGGCCGTATTAAAACCAAAACTGAGGGTGCGACAACAGACCACGCT GCACCCCTGAAAGGCAGATTCACCATCTCAAGAGATGATTCGAGAAA CACACTGTATCTCCAAATGGACAGCCTGACAACCGAGGACACAGCCG TGTATTTTTGTACCACAGGCCCACCTTATAGTTACTTTGACAGTACTG GGTATTCCATCGTTGACTACTGGGGCCAGGGAACCCTGGTCACCGTCT CCTCA |
| 21 | 322 | 322 | QVQLVESGGGLVKPGGSLRLSCAASGFIFSNAWMSWVRQSPGKGLEWV GRIKTKTEGATTDHAAPLKGRFTISRDDSRNTLYLQMDSLTTEDTAVYFC TTGPPYSYFDSTGYSIVDYWGQGTLVTVSS |
| 21 | 323 | 323 | FIFSNAWMS |
| 21 | 324 | 324 | TTCATTTTCAGTAACGCCTGGATGAGT |
| 21 | 325 | 325 | RIKTKTEGATTDHAAPLKG |

TABLE 6-continued

Informal Sequence Listing

| Antibody No. | Seq. Ref. No. | SEQ ID NO. | Sequence |
|---|---|---|---|
| 21 | 326 | 326 | CGTATTAAAACCAAAACTGAGGGTGCGACAACAGACCACGCTGCACC<br>CCTGAAAGGC |
| 21 | 327 | 327 | TTGPPYSYFDSTGYSIVDY |
| 21 | 328 | 328 | ACCACAGGCCCACCTTATAGTTACTTTGACAGTACTGGGTATTCCATC<br>GTTGACTAC |
| 21 | 329 | 329 | TCTTATGAGCTGACACAGCCACCCGCAGCGTCTGGGACCCCCGGGCA<br>GAGGGTCACCATCTCTTGTTCCGGAAGCAGCTCCAACATCGGAAGTG<br>AGTATGTATTGTGGTATCAGCAGGTCCCAGGAACGGCCCCCAAACTC<br>CTCATCTATAATAGTCATCAGCGGCCCTCAGGGGTCCCTGACCGCATT<br>TCTGGCTCCCGGTCTGGCACCTCTGCCTCCCTGGCCATCAGTGGGCTC<br>CGGTCCGAGGATGAGGCTCATTATTACTGTGCATCCTGGGATGACAG<br>CCTGAGTGGTCCGGTTTTCGGCGAGGGACCCAGCTGACCGTCCTC |
| 21 | 330 | 330 | SYELTQPPAASGTPGQRVTISCSGSSSNIGSEYVLWYQQVPGTAPKLLIYN<br>SHQRPSGVPDRISGSRSGTSASLAISGLRSEDEAHYYCASWDDSLSGPVF<br>GGGTQLTVL |
| 21 | 331 | 331 | SGSSSNIGSEYVL |
| 21 | 332 | 332 | TCCGGAAGCAGCTCCAACATCGGAAGTGAGTATGTATTG |
| 21 | 333 | 333 | NSHQRPS |
| 21 | 334 | 334 | AATAGTCATCAGCGGCCCTCA |
| 21 | 335 | 335 | ASWDDSLSGPV |
| 21 | 336 | 336 | GCATCCTGGGATGACAGCCTGAGTGGTCCGGTT |
| 22 | 337 | 337 | CAGGTCCAGCTTGTACAGTCTGGGGGAGGCTTGGTAAAGCCTGGGGG<br>GTCCCTTAGACTCTCATGTGCAGCCTCTGGATTCACTTTCAGTAACGC<br>CTGGATGAGCTGGGTCCGCCAGGCTCCAGGGAAGGGGCTGGACTGGG<br>TTGGCCGTATCAAAACCAAAGCTGATGGTGGGACAAGAGACTACGCT<br>GCACCCGTGAAAGGCAGATTTACCATCTCGAGAGATGATTCAGAAAA<br>CACGTTGTATCTGCAAATGACCAGCCTGAAAACCGAGGACACAGGCG<br>TGTATTACTGTAGCACAGGCCCACCCTATAAATATCATGATAGTACTG<br>GTTATTCGGTCGTTGACTACTGGGGCCAGGGAACCCTGGTCACTGTCT<br>CCTCA |
| 22 | 338 | 338 | QVQLVQSGGGLVKPGGSLRLSCAASGFTFSNAWMSWVRQAPGKGLDW<br>VGRIKTKADGGTRDYAAPVKGRFTISRDDSENTLYLQMTSLKTEDTGVY<br>YCSTGPPYKYHDSTGYSVVDYWGQGTLVTVSS |
| 22 | 339 | 339 | FTFSNAWMS |
| 22 | 340 | 340 | TTCACTTTCAGTAACGCCTGGATGAGC |
| 22 | 341 | 341 | RIKTKADGGTRDYAAPVKG |
| 22 | 342 | 342 | CGTATCAAAACCAAAGCTGATGGTGGGACAAGAGACTACGCTGCACC<br>CGTGAAAGGC |
| 22 | 343 | 343 | STGPPYKYHDSTGYSVVDY |
| 22 | 344 | 344 | AGCACAGGCCCACCCTATAAATATCATGATAGTACTGGTTATTCGGTC<br>GTTGACTAC |
| 22 | 345 | 345 | TCTTATGAGCTGACTCAGCCACCCTCAGCGTCTGGGACCCCCGGGCA<br>GAGGGTCACCATCTCCTGTTCTGGAGGCAGCTCCAACATCGGAAGTG<br>ATTATGTATACTGGTACCAGCAGCTCCCAGGAACGGCCCCCAAACTC<br>CTCATCTATGGTAGTAGTCAGCGACCCTCAGGGGTCCCTGACCGATTC<br>TCTGGCTCCCAGTCTGGCACCTCAGCCTCCCTGGCCATCAGTGGTCTC<br>CGGTCCGAGGATGAGGCTGATTATTACTGTGCTATGTGGGATGACAG<br>CCTGAATGGTCCGGTGTTCGGCGAGGGACCAAGCTGACCGTCCTA |
| 22 | 346 | 346 | SYELTQPPSASGTPGQRVTISCSGGSSNIGSDYVYWYQQLPGTAPKLLIYG<br>SSQRPSGVPDRFSGSQSGTSASLAISGLRSEDEADYYCAMWDDSLNGPVF<br>GGGTKLTVL |
| 22 | 347 | 347 | SGGSSNIGSDYVY |

TABLE 6-continued

Informal Sequence Listing

| Antibody No. | Seq. Ref. No. | SEQ ID NO. | Sequence |
|---|---|---|---|
| 22 | 348 | 348 | TCTGGAGGCAGCTCCAACATCGGAAGTGATTATGTATAC |
| 22 | 349 | 349 | GSSQRPS |
| 22 | 350 | 350 | GGTAGTAGTCAGCGACCCTCA |
| 22 | 351 | 351 | AMWDDSLNGPV |
| 22 | 352 | 352 | GCTATGTGGGATGACAGCCTGAATGGTCCGGTG |
| 23 | 353 | 353 | CAGGTGCAGCTACAGCAGTGGGGCGCAGGACTGTTGAAGCCTTCGGAGACCCTGTCCCTCTCCTGCACCGTCTCTGGTGGGGTCTTCGGCAATTACTTTTGGAGTTGGGTCCGCCAGGCCCCAGGGAAGGGCCTGGAATGGATTGGAGAAATCAATCAGATTGGAACCACCAACTACAGTCCGTCCGCGTCCCTCAAGAGTCGAGTCACTATATCAGTTGACCCGTCCAGGAACCAGTTCTCCCTGAGCCTGAGGTCTGTGACCGCCGCGGACACGGCTCGGTATTACTGTACGAGATCCGAAACTTCAGATTACTTTGATAGTAGTGGTTATGCATTTCATATCTGGGGCGAAGGGACAATGGTCACCGTCTCTTCA |
| 23 | 354 | 354 | QVQLQQWGAGLLKPSETLSLSCTVSGGVFGNYFWSWVRQAPGKGLEWIGEINQIGTTNYSPSASLKSRVTISVDPSRNQFSLSLRSVTAADTARYYCTRSETSDYFDSSGYAFHIWGEGTMVTVSS |
| 23 | 355 | 355 | GVFGNYFWS |
| 23 | 356 | 356 | GGGGTCTTCGGCAATTACTTTTGGAGT |
| 23 | 357 | 357 | EINQIGTTNYSPSASLKS |
| 23 | 358 | 358 | GAAATCAATCAGATTGGAACCACCAACTACAGTCCGTCCGCGTCCCTCAAGAGT |
| 23 | 359 | 359 | TRSETSDYFDSSGYAFHI |
| 23 | 360 | 360 | ACGAGATCCGAAACTTCAGATTACTTTGATAGTAGTGGTTATGCATTTCATATC |
| 23 | 361 | 361 | CTGCCTGTGCTGACTCAGCCTGCCTCCGTGTCTGGGTCTCCTGGACAGTCGATCACCATCTCCTGCAGTGGAATCAGCAGTGACGGTGGTCGCTATAACTATGTGTCCTGGTACCAACAACACCCGGGCAAAGCCCCCAAACTCCTCATCTATGATGACAGTAATTGGCCTTTAGGGGTTTCTCATCGCTTCTCTGGGTCCAAGTCTGGCAACACGGCCTCCCTGACCATCTCTGGGCTCCGGGCTGAGGACGAGGCGGACTATTATTGCGGCTCATATACGGACACCAACAGACTCTTCGGCGGAGGCACCCAGCTGACCGTCCTC |
| 23 | 362 | 362 | LPVLTQPASVSGSPGQSITISCSGISSDGGRYNYVSWYQQHPGKAPKLLIYDDSNWPLGVSHRFSGSKSGNTASLTISGLRAEDEADYYCGSYTDTNRLFGGGTQLTVL |
| 23 | 363 | 363 | SGISSDGGRYNYVS |
| 23 | 364 | 364 | AGTGGAATCAGCAGTGACGGTGGTCGCTATAACTATGTGTCC |
| 23 | 365 | 365 | DDSNWPL |
| 23 | 366 | 366 | GATGACAGTAATTGGCCTTTA |
| 23 | 367 | 367 | GSYTDTNRL |
| 23 | 368 | 368 | GGCTCATATACGGACACCAACAGACTC |
| 24 | 369 | 369 | GAGGTGCAGCTGGTGGAGTCGGGGGGAGGCGTGGTCCAGCCTGGGAGGTCCCTGAGACTCTCCTGTGCAGCCTCTGGATTCACCTTCAGTGACCATGCTATGTACTGGGTCCGCCAGGCTCCAGGCAAGGGGCTAGAGTGGGTGGCACTTATATCATTTGATGGAAGGAATATATACTACGCAGACTCCGTGAAGGGCCGATTCACCATCTCCAGAGACAATTCCAAGAACACGCTGTATCTGCAGATGAACAGCCTGAGAGCTGAGGACACGGCTGTCTATTACTGTGCGAGAGATCAATGGCTGGTTCCTGACTACTGGGGCCAGGGAACCCTGGTCACCGTCTCCTCA |
| 24 | 370 | 370 | EVQLVESGGGVVQPGRSLRLSCAASGFTFSDHAMYWVRQAPGKGLEWVALISFDGRNIYYADSVKGRFTISRDNSKNTLYLQMNSLRAEDTAVYYCARDQWLVPDYWGQGTLVTVSS |

TABLE 6-continued

Informal Sequence Listing

| Antibody No. | Seq. Ref. No. | SEQ ID NO. | Sequence |
|---|---|---|---|
| 24 | 371 | 371 | FTFSDHAMY |
| 24 | 372 | 372 | TTCACCTTCAGTGACCATGCTATGTAC |
| 24 | 373 | 373 | LISFDGRNIYYADSVKG |
| 24 | 374 | 374 | CTTATATCATTTGATGGAAGGAATATATACTACGCAGACTCCGTGAAGGGC |
| 24 | 375 | 375 | ARDQWLVPDY |
| 24 | 376 | 376 | GCGAGAGATCAATGGCTGGTTCCTGACTAC |
| 24 | 377 | 377 | CTGCCTGTGCTGACTCAGCCTGCCTCCGTGTCTGGGTCTCCTGGACAGTCGATCACCATCTCCTGCACTGGAACCAGCAGTGACGTTGGTGGTTATAACTATGTCTCCTGGTACCAACAGCACCCAGGCAACGCCCCCAAACTCATGATTTATGAAGTCAGTAAGCGGCCCTCAGGGGTCCCTGATCGCTTCTCTGGCTTCAAGTCTGGCAACACGGCCTCCCTGACCGTCTCTGGGCTCCAGGCTGAGGATGAGGCTGATTATTACTGCAGCTCATATGCAGGCAGCAACAGTGTCTTCGGAACTGGGACCAAGCTCACCGTCCTA |
| 24 | 378 | 378 | LPVLTQPASVSGSPGQSITISCTGTSSDVGGYNYVSWYQQHPGNAPKLMIYEVSKRPSGVPDRFSGFKSGNTASLTVSGLQAEDEADYYCSSYAGSNSVFGTGTKLTVL |
| 24 | 379 | 379 | TGTSSDVGGYNYVS |
| 24 | 380 | 380 | ACTGGAACCAGCAGTGACGTTGGTGGTTATAACTATGTCTCC |
| 24 | 381 | 381 | EVSKRPS |
| 24 | 382 | 382 | GAAGTCAGTAAGCGGCCCTCA |
| 24 | 383 | 383 | SSYAGSNSV |
| 24 | 384 | 384 | AGCTCATATGCAGGCAGCAACAGTGTC |
| 25 | 385 | 385 | CAGGTCCAGCTGGTGCAGTCTGGGGGAGGCGTGGTCCAGCCTGGGGGGTCCCTGAGACTCTCCTGTGCAGCGTATGGACTCACCTTCAGGGCCTATGGCATGCACTGGGTCCGCCAGGCTCCAGGCAAGGGGCTCGAGTGGGTGGCAGTGTCATGGTATGACGGAACAAATGAAGTCTATGCAGACTCAGTGAAGGGCCGCTTCAGAATCTCCAGAGATGATTCCAGGAGCACTCTATATTTGCAAATGAATAGTCTGAGAGGCGAGGACACGGCTGTATATTACTGTGCGACAGAAAGGATGTGGGAGGAAAACTCCAGCAGCTTCGGCTGGTGGGGCCGGGGAACCCTGGTCACCGTCTCCTCA |
| 25 | 386 | 386 | QVQLVQSGGGVVQPGGSLRLSCAAYGLTFRAYGMHWVRQAPGKGLEWVAVSWYDGTNEVYADSVKGRFRISRDDSRSTLYLQMNSLRGEDTAVYYCATERMWEENSSSFGWWGRGTLVTVSS |
| 25 | 387 | 387 | LTFRAYGMH |
| 25 | 388 | 388 | CTCACCTTCAGGGCCTATGGCATGCAC |
| 25 | 389 | 389 | VSWYDGTNEVYADSVKG |
| 25 | 390 | 390 | GTGTCATGGTATGACGGAACAAATGAAGTCTATGCAGACTCAGTGAAGGGC |
| 25 | 391 | 391 | ATERMWEENSSSFGW |
| 25 | 392 | 392 | GCGACAGAAAGGATGTGGGAGGAAAACTCCAGCAGCTTCGGCTGG |
| 25 | 393 | 393 | CAGGCTGTGCTGACTCAGCCTGCCTCCGTGTCTGGGTCTCCTGGACAGTCGATCACCATTTCCTGCACTGGAAGCAGCAGTGACGTTGGTGGTTCTAACTTTGTCTCCTGGTACCAACAACACCCAGGCAAAGCCCCCAAACTCATGGTTTATGATGTCAATCATCGGCCCTCAGGGATTTCTAATCGCTTCTCTGGCTCCAAGTCTGGCAACACGGCCTCCCTGACCATCTCTGGGCTCCAGGCTGAGGACGAGGCTGATTATTACTGCACCTCATATACAAGTAGAAGCTCTTATGTCTTCGGAAGTGGGACCAAGGTGACCGTACTT |
| 25 | 394 | 394 | QAVLTQPASVSGSPGQSITISCTGSSSDVGGSNFVSWYQQHPGKAPKLMVYDVNHRPSGISNRFSGSKSGNTASLTISGLQAEDEADYYCTSYTSRSSYVFGSGTKVTVL |

TABLE 6-continued

Informal Sequence Listing

| Antibody Ref. No. | Seq. Ref. No. | SEQ ID NO. | Sequence |
|---|---|---|---|
| 25 | 395 | 395 | TGSSSDVGGSNFVS |
| 25 | 396 | 396 | ACTGGAAGCAGCAGTGACGTTGGTGGTTCTAACTTTGTCTCC |
| 25 | 397 | 397 | DVNHRPS |
| 25 | 398 | 398 | GATGTCAATCATCGGCCCTCA |
| 25 | 399 | 399 | TSYTSRSSYV |
| 25 | 400 | 400 | ACCTCATATACAAGTAGAAGCTCTTATGTC |
| 26 | 401 | 401 | CAGGTCCAGCTGGTACAGTCTGGAACTGAAGTGAAGAAGCCTGGGGC<br>CTCAGTGAAGGTCTCCTGTAAGGCCTCTGGGTACATCTTCGACCACTT<br>TGCTATCACCTGGGTGCGCCAGGCCCCTGGACAAGGGCCTGAGTGGA<br>TGGGATGGATCAGCGCTTATAATGGGAGAACAGAGGATTCAGGGAA<br>ATTCCCGGGCAGACTCACCCTGACCACAGACCCCGCCACGCGGACAG<br>CCTTCCTGGAACTGAGGGGCCTGACACCTGACGACACGGCCGTTTATT<br>ACTGTGCGCGAGATGTCCCGGTCATGGGAGCCGCATTTTTGGACTACT<br>GGGGCCAGGGAACCCTGGTCACCGTCTCCTCA |
| 26 | 402 | 402 | QVQLVQSGTEVKKPGASVKVSCKASGYIFDHFAITWVRQAPGQGPEWM<br>GWISAYNGRTEDSGKFPGRLTLTTDPATRTAFLELRGLTPDDTAVYYCA<br>RDVPVMGAAFLDYWGQGTLVTVSS |
| 26 | 403 | 403 | YIFDHFAIT |
| 26 | 404 | 404 | TACATCTTCGACCACTTTGCTATCACC |
| 26 | 405 | 405 | WISAYNGRTEDSGKFPG |
| 26 | 406 | 406 | TGGATCAGCGCTTATAATGGGAGAACAGAGGATTCAGGGAAATTCCC<br>GGGC |
| 26 | 407 | 407 | ARDVPVMGAAFLDY |
| 26 | 408 | 408 | GCGCGAGATGTCCCGGTCATGGGAGCCGCATTTTTGGACTAC |
| 26 | 409 | 409 | GAAATTGTATTGACACAGTCTCCACTCTCCCTGCCCGTCACTGTTGGA<br>CAGCCGGCCTCCATCTCCTGCAGGTCTGGCCAAAGTCTCGAATTCAGT<br>GATGGAAACACCTACTTGACTTGGTTTCACCAGAGGCCAGGCCAATC<br>TCCAAGGCGCCTAATTTATAGGGGTTCTTACCGGGACTCTGGGGTCCC<br>CGACAGATTCCGCGGCAGTGGCTCAGGCACTACTTTCACACTGACAA<br>TCAGCAGGGTGGAGGCTGAGGATGTTGGGATTTATTTCTGCATGCAA<br>GGTACACACTGGCCTCCGACCTTCGGCCAAGGGACCAAAGTGGATAT<br>CAAA |
| 26 | 410 | 410 | EIVLTQSPLSLPVTVGQPASISCRSGQSLEFSDGNTYLTWFHQRPGQSPRR<br>LIYRGSYRDSGVPDRFRGSGSGTTFTLTISRVEAEDVGIYFCMQGTHWPP<br>TFGQGTKVDIK |
| 26 | 411 | 411 | RSGQSLEFSDGNTYLT |
| 26 | 412 | 412 | AGGTCTGGCCAAAGTCTCGAATTCAGTGATGGAAACACCTACTTGACT |
| 26 | 413 | 413 | RGSYRDS |
| 26 | 414 | 414 | AGGGGTTCTTACCGGGACTCT |
| 26 | 415 | 415 | MQGTHWPPT |
| 26 | 416 | 416 | ATGCAAGGTACACACTGGCCTCCGACC |
| 27 | 417 | 417 | CAGGTCCAGCTGGTGCAGTCTGGGGCTGAGGTGAAGAAGCCTGGGGC<br>CTCAGTGAAAGTCTCCTGTGAGGCCTCTGCATACAGTTTCAGCGGCGA<br>CTATGTTCACTGGGTGCGACAGGCCCCTGGACAAGGGCTTGAGTGGA<br>TGGGTTGGATAAAGGCTGTCAATGGTGGCGCAAACTATGCACAGAGG<br>TTTCACGGCAGGGTCACCATGACCACTGACTCGTCCAGGAGCACAGT<br>CTATCTGGAGCTGACCAGGCTGACACCTGACGACACGGCCGTTTATTT<br>TTGTGCGAAAGATCGAGCTGCAAGTGTTCATGTGCCAGCTGGTGAGT<br>TTGACCTCTGGGGCCAGGGAACCCTGGTCACCGTCTCCTCA |

TABLE 6-continued

Informal Sequence Listing

| Antibody No. | Seq. Ref. No. | SEQ ID NO. | Sequence |
|---|---|---|---|
| 27 | 418 | 418 | QVQLVQSGAEVKKPGASVKVSCEASAYSFSGDYVHWVRQAPGQGLEW MGWIKAVNGGANYAQRFHGRVTMTTDSSRSTVYLELTRLTPDDTAVYF CAKDRAASVHVPAGEFDLWGQGTLVTVSS |
| 27 | 419 | 419 | YSFSGDYVH |
| 27 | 420 | 420 | TACAGTTTCAGCGGCGACTATGTTCAC |
| 27 | 421 | 421 | WIKAVNGGANYAQRFHG |
| 27 | 422 | 422 | TGGATAAAGGCTGTCAATGGTGGCGCAAACTATGCACAGAGGTTTCA CGGC |
| 27 | 423 | 423 | AKDRAASVHVPAGEFDL |
| 27 | 424 | 424 | GCGAAAGATCGAGCTGCAAGTGTTCATGTGCCAGCTGGTGAGTTTGA CCTC |
| 27 | 425 | 425 | GACATCCAGGTGACCCAGTCTCCTTCCTCCCTGTCTGCATCTGTAGGA GACAGAGTCAGCATCACTTGTCGGGCAAGTCAGAGCATTAGCAACTT TTTAAATTGGTATCGGCAGAGACCAGGGAAAGCCCCTGAGCTCCTAA TCTATGCTGCCTCCACTTTGCAAGGTGGGGTCCCATCAAGGTTCAGTG GCAGTGGATCTGGGACACATTTCACTCTCACCATCAGCAGTCTCCAGC CTGAAGATTTTGCAACTTACTACTGTCAACAGAGTTACACTATTCCTT CGATCACCTTCGGCCAAGGGACACGACTGGAGATTAAA |
| 27 | 426 | 426 | DIQVTQSPSSLSASVGDRVSITCRASQSISNFLNWYRQRPGKAPELLIYAA STLQGGVPSRFSGSGSGTHFTLTISSLQPEDFATYYCQQSYTIPSITFGQGT RLEIK |
| 27 | 427 | 427 | RASQSISNFLN |
| 27 | 428 | 428 | CGGGCAAGTCAGAGCATTAGCAACTTTTTAAAT |
| 27 | 429 | 429 | AASTLQG |
| 27 | 430 | 430 | GCTGCCTCCACTTTGCAAGGT |
| 27 | 431 | 431 | QQSYTIPSIT |
| 27 | 432 | 432 | CAACAGAGTTACACTATTCCTTCGATCACC |
| 28 | 433 | 433 | CAGGTGCAGCTGTTGGAGTCGGGCGCAGGACTTTTGAAGCCTTCGGA GACCCTGTCCCTCACCTGCTCTTTGTCTGGTGGGTCCTTCAGAGACTT CTACTGGGCCTGGATTCGCCAGGCCCCCGGGAGGGGGCTGGAGTGGA TTGGGGACATCAATGACGGTGGAAACACCAACCACAGTCCGTCCCTC AAGAGTCGAGCCATCCTTTCCATAGACGCGTCCAAGAGGCAGTTCTC CCTGAGACTGACCTCTGTGACCGCCGCGGACACGGCTGTTTATTATTG CGCGAGACAGAGGCTCGAACACACGGCATCTGGATATTACATGGACG TCTGGGGCAACGGGACCACGGTCACCGTCTCCTCA |
| 28 | 434 | 434 | QVQLLESGAGLLKPSETLSLTCSLSGGSFRDFYWAWIRQAPGRGLEWIG DINDGGNTNHSPSLKSRAILSIDASKRQFSLRLTSVTAADTAVYYCARQR LEHTASGYYMDVWGNGTTVTVSS |
| 28 | 435 | 435 | GSFRDFYWA |
| 28 | 436 | 436 | GGGTCCTTCAGAGACTTCTACTGGGCC |
| 28 | 437 | 437 | DINDGGNTNHSPSLKS |
| 28 | 438 | 438 | GACATCAATGACGGTGGAAACACCAACCACAGTCCGTCCCTCAAGAGT |
| 28 | 439 | 439 | ARQRLEHTASGYYMDV |
| 28 | 440 | 440 | GCGAGACAGAGGCTCGAACACACGGCATCTGGATATTACATGGACGTC |
| 28 | 441 | 441 | CAGTCTGTCCTGACGCAGCCGCCCTCGGTGTCAGTGGACCCAGGAGA GACGGCCACCATTACCTGTGGCGGAGCCAACATTGGTTCTAAAATG TCTACTGGTATCAGCAGAGGCCAGGCCAGGCCCCTGTGCTGGTCGTCT ATGATGATATCGACCGGCCCGCAGGGATCCCTGATCGATTCACTGAC TCTAGTTCTGGGAACACGGTCACCCTGACCATCTACAGCGTCGAGGC |

TABLE 6-continued

Informal Sequence Listing

| Antibody Ref. No. | Seq. Ref. No. | SEQ ID NO. | Sequence |
|---|---|---|---|
| | | | CGTGGATGAGGCCGACTATTTCTGTCAGGTGTGGGATAATTCTTCTGA TCAGCCGGTGTTCGGCGGAGGGACCAAGCTCACCGTCCTC |
| 28 | 442 | 442 | QSVLTQPPSVSVDPGETATITCGGANIGSKNVYWYQQRPGQAPVLVVYD DIDRPAGIPDRFTDSSSGNTVTLTIYSVEAVDEADYFCQVWDNSSDQPVF GGGTKLTVL |
| 28 | 443 | 443 | GGANIGSKNVY |
| 28 | 444 | 444 | GGCGGAGCCAACATTGGTTCTAAAAATGTCTAC |
| 28 | 445 | 445 | DDIDRPA |
| 28 | 446 | 446 | GATGATATCGACCGGCCCGCA |
| 28 | 447 | 447 | QVWDNSSDQPV |
| 28 | 448 | 448 | CAGGTGTGGGATAATTCTTCTGATCAGCCGGTG |
| 29 | 449 | 449 | CAGGTCCAGCTTGTGCAGTCTGGAGCAGAGGCGAAAAAGCCCGGGG AGCCTCTGAGGATCTCCTGTAAGGGTTCTGGATACACCTTTAGCAGCT ACTGGATCAGCTGGGTGCGCCAGAGGCCCGGGGAACGCCTGGAGTGG ATGGGGAGAATTGATCCGAGTGACTCCTATGCCTACTCGAGCCCGTC CTTCCAAGGCCACGTCACCTTCTCAGCTGACAAGTCCAGCAACACTGC CTTTTTGCAGTGGAGCAGCCTGCAGGCCTCGGACACCGCCATCTATTA CTGCGCGAGACACAAAGAGAATTACGATTTTTGGGATTTCTGGGGCC AGGGCACAATGGTCACCGTCTCTTCA |
| 29 | 450 | 450 | QVQLVQSGAEAKKPGEPLRISCKGSGYTFSSYWISWVRQRPGERLEWMG RIDPSDSYAYSSPSFQGHVTFSADKSSNTAFLQWSSLQASDTAIYYCARH KENYDFWDFWGQGTMVTVSS |
| 29 | 451 | 451 | YTFSSYWIS |
| 29 | 452 | 452 | TACACCTTTAGCAGCTACTGGATCAGC |
| 29 | 453 | 453 | RIDPSDSYAYSSPSFQG |
| 29 | 454 | 454 | AGAATTGATCCGAGTGACTCCTATGCCTACTCGAGCCCGTCCTTCCAA GGC |
| 29 | 455 | 455 | ARHKENYDFWDF |
| 29 | 456 | 456 | GCGAGACACAAAGAGAATTACGATTTTTGGGATTTC |
| 29 | 457 | 457 | GAAACGACACTCACGCAGTCTCCAGACTCCCTGGCTGTGTCCCTGGG CGAGAGGGCCACCATCAACTGCAGGTCCAGCCAGCCTATTTTGTTCA ACCCCATCAATAAACTCTCCTTAGCTTGGTACCAGCTCAAACCAGGAC AGCCTCCTAAGCTGCTCATTTCCTGGGCATCTACCCGGGAACCCGGGG TCCCTGACCGATTCAATGGCAGCGGGTCTGGGACAGTTTTCACTCTCA CCATCAGCAGCCTGCAGCCTGAAGATGTGGCAGTTTATGTCTGTCAGC AATATTTTACTAGTACTTTTTTCGGCCCTGGGACCAAGGTGGAAATCA AA |
| 29 | 458 | 458 | ETTLTQSPDSLAVSLGERATINCRSSQPILFNPINKLSLAWYQLKPGQPPK LLISWASTREPGVPDRFNGSGSGTVFTLTISSLQPEDVAVYVCQQYFTSTF FGPGTKVEIK |
| 29 | 459 | 459 | RSSQPILFNPINKLSLA |
| 29 | 460 | 460 | AGGTCCAGCCAGCCTATTTTGTTCAACCCCATCAATAAACTCTCCTTA GCT |
| 29 | 461 | 461 | WASTREP |
| 29 | 462 | 462 | TGGGCATCTACCCGGGAACCC |
| 29 | 463 | 463 | QQYFTSTF |
| 29 | 464 | 464 | CAGCAATATTTTACTAGTACTTTT |
| 30 | 465 | 465 | GAGGTGCAGCTGTTGGAGTCTGGAAGTGAGGTGAAGAAGCCTGGGAC CTCAGTGAAGGTCTCCTGCGAGACTTCTGGTTACATCTTTACCAACTA TGCTATCTCCTGGGTGCGACAGGCCCCTGGACAGGGTCTTGAGTGGCT |

TABLE 6-continued

Informal Sequence Listing

| Antibody No. | Seq. Ref. No. | SEQ ID NO. | Sequence |
|---|---|---|---|
| | | | GGGTTGGATCAGTGGTTACAATGGTCAGACCTACTATGCGCAGAAGG<br>TCCAGGGTAGACTCACCCTGACCACAGACACGTCCACGATGACAGCC<br>TACATGGACCTGACGAGCCTTAGATCTGACGACACGGCCATTTATTAT<br>TGTGTGAGAGATGTCCCCGTGATTTCAGGCGCTTCCACAATGGACTAC<br>TGGGGCCAGGGAACCCTGGTCACCGTCTCCTCA |
| 30 | 466 | 466 | EVQLLESGSEVKKPGTSVKVSCETSGYIFTNYAISWVRQAPGQGLEWLG<br>WISGYNGQTYYAQKVQGRLTLTTDTSTMTAYMDLTSLRSDDTAIYYCV<br>RDVPVISGASTMDYWGQGTLVTVSS |
| 30 | 467 | 467 | YIFTNYAIS |
| 30 | 468 | 468 | TACATCTTTACCAACTATGCTATCTCC |
| 30 | 469 | 469 | WISGYNGQTYYAQKVQG |
| 30 | 470 | 470 | TGGATCAGTGGTTACAATGGTCAGACCTACTATGCGCAGAAGGTCCA<br>GGGT |
| 30 | 471 | 471 | VRDVPVISGASTMDY |
| 30 | 472 | 472 | GTGAGAGATGTCCCCGTGATTTCAGGCGCTTCCACAATGGACTAC |
| 30 | 473 | 473 | GATATTGTGATGACGCAGTCTCCACTCTCCCTGCCCGTCACCCATGGA<br>CAGCCGGCCTCCATCTCCTGCAGGTCTAGTCAAAGCCTCGTTTACAGC<br>GATGGAAACACCTACTTGAGTTGGTTTCAGCTGAGGCCAGGCCAATC<br>TCCAAGGCGCTAATTTATAAGGTTTCTAACCGGGACTCTGGGGTCCC<br>AGACAGATTCAGCGGCAGTGGGTCAGGCACTGATTTCACACTGAAAA<br>TCAGCCGGGTGGAGGCTGAGGATGTTGGAGTTTATTACTGCATGCAA<br>GCTACACAGTGGCCTCGAACGTTCGGCCAAGGGACCAAGGTGGAGAT<br>CAAA |
| 30 | 474 | 474 | DIVMTQSPLSLPVTHGQPASISCRSSQSLVYSDGNTYLSWFQLRPGQSPRR<br>LIYKVSNRDSGVPDRFSGSGSGTDFTLKISRVEAEDVGVYYCMQATQWP<br>RTFGQGTKVEIK |
| 30 | 475 | 475 | RSSQSLVYSDGNTYLS |
| 30 | 476 | 476 | AGGTCTAGTCAAAGCCTCGTTTACAGCGATGGAAACACCTACTTGAGT |
| 30 | 477 | 477 | KVSNRDS |
| 30 | 478 | 478 | AAGGTTTCTAACCGGGACTCT |
| 30 | 479 | 479 | MQATQWPRT |
| 30 | 480 | 480 | ATGCAAGCTACACAGTGGCCTCGAACG |
| 31 | 481 | 481 | CAGGTCCAGCTTGTACAGTCTGGTCCTACGCTGGTGAGGCCCACACA<br>GACCCTCACGCTGACTTGCACCTTCTCTGGGTTCTCACTCTCTACTCGT<br>GGCGTGGGCGTGGGCTGGGTCCGTCAGTCCCCAGGAAAGGCCCCGGA<br>GTTCCTTGTTCTCGCTCATTGGGATGATGATAAGATCTACAGTCCATC<br>TCTCAGGCGCAGACTCTCCGTCACCAAGGATGTCTCCAAAAACCAGG<br>TGGTCCTTGCCTTGACCAACGTGGACCCTGTGGACACAGGCACATATT<br>TCTGTGTCAAGAGCGATCTCTATGATAGAGGTGGCTATTACTTATATT<br>ACTTTGATCATTGGGGTCAGGGAACCCTGGTCACCGTCTCCTCA |
| 31 | 482 | 482 | QVQLVQSGPTLVRPTQTLTLTCTFSGFSLSTRGVGVGWVRQSPGKAPEFL<br>VLAHWDDDKIYSPSLRRRLSVTKDVSKNQVVLALTNVDPVDTGTYFCV<br>KSDLYDRGGYYLYYFDHWGQGTLVTVSS |
| 31 | 483 | 483 | FSLSTRGVGVG |
| 31 | 484 | 484 | TTCTCACTCTCTACTCGTGGCGTGGGCGTGGGC |
| 31 | 485 | 485 | LAHWDDDKIYSPSLRR |
| 31 | 486 | 486 | CTCGCTCATTGGGATGATGATAAGATCTACAGTCCATCTCTCAGGCGC |
| 31 | 487 | 487 | VKSDLYDRGGYYLYYFDH |
| 31 | 488 | 488 | GTCAAGAGCGATCTCTATGATAGAGGTGGCTATTACTTATATTACTTT<br>GATCAT |

TABLE 6-continued

Informal Sequence Listing

| Antibody Ref. No. | Seq. Ref. No. | SEQ ID NO. | Sequence |
|---|---|---|---|
| 31 | 489 | 489 | GACATCCGGATGACCCAGTCTCCATCCTCCCTGTCTGCATCTGTGGGG GACAGAGTCACCATCACTTGCCGGGCAAGTCAGACCATTGCCAGTTA TGTGAATTGGTATCTGCAAAGACCAGGGGAAGCCCCTAAACTCCTGA TCTATGCAGCTTCCAATTTGCACAGTGGGGCCCCACCGTCACTCATTG GCAGGGGCTCTGGGACAGATTTCACTCTCACCATCAACACTCTGCAA CCTGAACATTTTGGAACTTACTTCTGTCAGCAGACTTTCTCCTCTCCAT ACACTTTTGGCCAGGGGACCAAGGTGGAAATCAAA |
| 31 | 490 | 490 | DIRMTQSPSSLSASVGDRVTITCRASQTIASYVNWYLQRPGEAPKLLIYA ASNLHSGAPPSLIGRGSGTDFTLTINTLQPEHFGTYFCQQTFSSPYTFGQG TKVEIK |
| 31 | 491 | 491 | RASQTIASYVN |
| 31 | 492 | 492 | CGGGCAAGTCAGACCATTGCCAGTTATGTGAAT |
| 31 | 493 | 493 | AASNLHS |
| 31 | 494 | 494 | GCAGCTTCCAATTTGCACAGT |
| 31 | 495 | 495 | QQTFSSPYT |
| 31 | 496 | 496 | CAGCAGACTTTCTCCTCTCCATACACT |
| 32 | 497 | 497 | CAGGTGCAGCTGGTGGAGTCTGGTCCTACGCTGGTGAAGCCCACACA GACCCTCACGCTGACCTGCACCTTCTCTGGGTTCTCACTCACTACTCG TGGCGTGGGTGTGGGCTGGGTCCGTCAGCCCCCAGGAAAGGCCCTGG AGTTCCTTGGACTCACTCATTGGGATGATGATAAGATCTACAGCCCAT CTCTCAGGCGCAGACTCACCATCACCAAGGACACCTCCAAAAACCAG GTGGTCCTTGCATTGGCCAACGTGGACCCTGTGGACACAGCCACATA TTTCTGTGTAAAAAGCGATCTCTATGATAGAGGTGGTTATTACTTATA CTACTTTGACTATTGGGGTCAGGGAACCCTGGTCACCGTCTCCTCA |
| 32 | 498 | 498 | QVQLVESGPTLVKPTQTLTLTCTFSGFSLTTRGVGVGWVRQPPGKALEFL GLTHWDDDKIYSPSLRRRLTITKDTSKNQVVLALANVDPVDTATYFCVK SDLYDRGGYYLYYFDYWGQGTLVTVSS |
| 32 | 499 | 499 | FSLTTRGVGVG |
| 32 | 500 | 500 | TTCTCACTCACTACTCGTGGCGTGGGTGTGGGC |
| 32 | 501 | 501 | LTHWDDDKIYSPSLRR |
| 32 | 502 | 502 | CTCACTCATTGGGATGATGATAAGATCTACAGCCCATCTCTCAGGCGC |
| 32 | 503 | 503 | VKSDLYDRGGYYLYYFDY |
| 32 | 504 | 504 | GTAAAAAGCGATCTCTATGATAGAGGTGGTTATTACTTATACTACTTT GACTAT |
| 32 | 505 | 505 | GAAATTGTGTTGACACAGTCTCCATCCTCCCTGTCTGCATCTGTGGGG GACAGAGTCACCATCACTTGCCGGGCAAGTCAGACCATTCCCAGTTA TGTAAATTGGTATCTGCAAAGACCAGGGGAAGCCCCTAAACTCCTGA TCTATGGTGCTTCCAATTTGCACACTGGGGCCCCACCAACATTCATTG GCAGGGGATCTGGGGCAGATTTCACTCTCACCATCAACACTCTGCAA CCTGAACATTTTGGAACCTACTACTGTCAACAGACTTTCTCCTCTCCA TACACTTTTGGCCAGGGGACCAAGGTGGAAATCAAA |
| 32 | 506 | 506 | EIVLTQSPSSLSASVGDRVTITCRASQTIPSYVNWYLQRPGEAPKLLIYGA SNLHTGAPPTFIGRGSGADFTLTINTLQPEHFGTYYCQQTFSSPYTFGQGT KVEIK |
| 32 | 507 | 507 | RASQTIPSYVN |
| 32 | 508 | 508 | CGGGCAAGTCAGACCATTCCCAGTTATGTAAAT |
| 32 | 509 | 509 | GASNLHT |
| 32 | 510 | 510 | GGTGCTTCCAATTTGCACACT |
| 32 | 511 | 511 | QQTFSSPYT |
| 32 | 512 | 512 | CAACAGACTTTCTCCTCTCCATACACT |

TABLE 6-continued

Informal Sequence Listing

| Antibody No. | Seq. Ref. No. | SEQ ID NO. | Sequence |
|---|---|---|---|
| 33 | 513 | 513 | CAGGTCACCTTGAAGGAGTCTGGTCCTGCGCTGGTGAAACCCACAGA<br>GACCCTCACACTGACCTGTACCTTCTCTGGCTTCTCACTCAGCACTAA<br>AAGACTGAGTGTGAGTTGGATCCGTCAGCCCCCAGGGAAGGCCCTGG<br>AGTGGCTTGCTCGCATAGATTGGGATGATGATAAATCTTACAGCACA<br>TCTCTGAGGACCAGGCTCACCATCGCCAAGGACACTTCCAAAAACCA<br>GGTCGTCCTTACAATGACCAACATGGGCCCCGCGGACACAGCCACCT<br>ATTTCTGTGTTCGGTCTTCTGTATATGCTAGTAATGCTTATTACCTCTA<br>CTACTTTGACTCTTGGGGCCAGGGAACCCTGGTCACCGTCTCCTCA |
| 33 | 514 | 514 | QVTLKESGPALVKPTETLTLTCTFSGFSLSTKRLSVSWIRQPPGKALEWL<br>ARIDWDDDKSYSTSLRTRLTIAKDTSKNQVVLTMTNMGPADTATYFCV<br>RSSVYASNAYYLYYFDSWGQGTLVTVSS |
| 33 | 515 | 515 | FSLSTKRLSVS |
| 33 | 516 | 516 | TTCTCACTCAGCACTAAAAGACTGAGTGTGAGT |
| 33 | 517 | 517 | RIDWDDDKSYSTSLRT |
| 33 | 518 | 518 | CGCATAGATTGGGATGATGATAAATCTTACAGCACATCTCTGAGGACC |
| 33 | 519 | 519 | VRSSVYASNAYYLYYFDS |
| 33 | 520 | 520 | GTTCGGTCTTCTGTATATGCTAGTAATGCTTATTACCTCTACTACTTTG<br>ACTCT |
| 33 | 521 | 521 | GACATCCGGATGACCCAGTCTCCATCTTCCCTGTCTGCATCTGTCGGA<br>GACAGAGTCACCATCACTTGCCGGGCAAGTCAGAGCATTGCCACCTA<br>CTTAAATTGGTATCAGCACAAACCAGGGAAAGCCCCTACCCTCCTGA<br>TCTATGCTGCATCCATTTTGCACAGTGGTGTCCCGCCAAGGTTCAGTG<br>GCCGTGCCTCTGGGACAGATTTCACTCTCACCATCAGCAGTCTGCAAC<br>CTGAAGATTTTGCAACTTACTACTGTCAACAGGCCTACAGTTCCCCTT<br>ACACTTTTGGCCAGGGGACCAAAGTGGATATCAAA |
| 33 | 522 | 522 | DIRMTQSPSSLSASVGDRVTITCRASQSIATYLNWYQHKPGKAPTLLIYA<br>ASILHSGVPPRFSGRASGTDFTLTISSLQPEDFATYYCQQAYSSPYTFGQG<br>TKVDIK |
| 33 | 523 | 523 | RASQSIATYLN |
| 33 | 524 | 524 | CGGGCAAGTCAGAGCATTGCCACCTACTTAAAT |
| 33 | 525 | 525 | AASILHS |
| 33 | 526 | 526 | GCTGCATCCATTTTGCACAGT |
| 33 | 527 | 527 | QQAYSSPYT |
| 33 | 528 | 528 | CAACAGGCCTACAGTTCCCCTTACACT |
| 34 | 529 | 529 | CAGGTCCAGCTGGTGCAGTCTGGGGCTGAGGTGAAGAAGCCTGGGTC<br>CTCAGTGAAGGTCTCCTGCAAGGCTTCTGGAGGCACCTTCGGCAGCT<br>ATGCTGTCATCTGGGTGCGACAGGCCCCTGGACAAGGGCTTGAGTGG<br>ATGGGACATATCATCCCTGTTTTTGGGACAATAAACAACGCACAGAA<br>GTTCCAGGGCAGACTCACCCTTAGCGCAGACGAATCCACGGGCACAG<br>TCTACATGGGGCTGAGCAGCCTGAGATCTGACGACACGGCCGTGTAT<br>TTCTGTGCGACCAAGAGATATTGTAGTGATCCCAGCTGCCATGGACTC<br>TGGTACTTCGATCTCTGGGGCCGTGGCACCCTGGTCACCGTCTCCTCA |
| 34 | 530 | 530 | QVQLVQSGAEVKKPGSSVKVSCKASGGTFGSYAVIWVRQAPGQGLEW<br>MGHIIPVFGTINNAQKFQGRLTLSADESTGTVYMGLSSLRSDDTAVYFCA<br>TKRYCSDPSCHGLWYFDLWGRGTLVTVSS |
| 34 | 531 | 531 | GTFGSYAVI |
| 34 | 532 | 532 | GGCACCTTCGGCAGCTATGCTGTCATC |
| 34 | 533 | 533 | HIIPVFGTINNAQKFQG |
| 34 | 534 | 534 | CATATCATCCCTGTTTTTGGGACAATAAACAACGCACAGAAGTTCCA<br>GGGC |
| 34 | 535 | 535 | ATKRYCSDPSCHGLWYFDL |

TABLE 6-continued

Informal Sequence Listing

| Antibody No. | Seq. Ref. No. | SEQ ID NO. | Sequence |
|---|---|---|---|
| 34 | 536 | 536 | GCGACCAAGAGATATTGTAGTGATCCCAGCTGCCATGGACTCTGGTA<br>CTTCGATCTC |
| 34 | 537 | 537 | GACATCCGGTTGACCCAGTCTCCACTCTCCCTGCCCGTCACCCCTGGA<br>GAGCCGGCCTCCATCTCCTGCAGGTCTAGTCAGAGCCTCTTGGATAGT<br>GATGATGGAAACACCTATTTGGACTGGTACCTGCAGAAGCCAGGGCA<br>GTCTCCACAGGTCCTGATCTATATGCTTTCGTATCGGGCCTCTGGAGT<br>CCCAGACAGGTTCAGTGGCAGTGGGTCAGGCACTGATTTCACACTGA<br>AAATCAGCAGGGTGGAGGCTGAGGATGTTGGAGTTTATTACTGCATG<br>CAACGTGCAGAGTTTCCTTACACTTTTGGCCAGGGGACCAAGCTGGA<br>GATCAAA |
| 34 | 538 | 538 | DIRLTQSPLSLPVTPGEPASISCRSSQSLLDSDDGNTYLDWYLQKPGQSPQ<br>VLIYMLSYRASGVPDRFSGSGSGTDFTLKISRVEAEDVGVYYCMQRAEF<br>PYTFGQGTKLEIK |
| 34 | 539 | 539 | RSSQSLLDSDDGNTYLD |
| 34 | 540 | 540 | AGGTCTAGTCAGAGCCTCTTGGATAGTGATGATGGAAACACCTATTT<br>GGAC |
| 34 | 541 | 541 | MLSYRAS |
| 34 | 542 | 542 | ATGCTTTCGTATCGGGCCTCT |
| 34 | 543 | 543 | MQRAEFPYT |
| 34 | 544 | 544 | ATGCAACGTGCAGAGTTTCCTTACACT |
| 35 | 545 | 545 | CAGGTCCAGCTTGTGCAGTCTGGAGCAGAGGTGAAAAAGCCCGGGGA<br>GCCTCTGAGGATCTCCTGTAAGGGTTCTGGATACACCTTTACCAGCTA<br>CTGGATCAGTTGGGTGCGCCAGATGCCCGGGACAGGCCTTGAGTGGA<br>TGGGGAGAATTGATCCGAGTGACTCCTATACCTACTCGAGCCCGTCCT<br>TCCAAGGCCACGTCACCATCTCAGTTGACAAGTCCATCAGCACTGCCT<br>ACCTGCAATGGAGCAGCCTGAAGGCCTCGGACACCGCCATATATTAC<br>TGTGCGAGACACAAAGAGAATTACGATTTTTGGGATTTTTGGGGCCA<br>GGGAACCCTGGTCACCGTCTCCTCA |
| 35 | 546 | 546 | QVQLVQSGAEVKKPGEPLRISCKGSGYTFTSYWISWVRQMPGTGLEWM<br>GRIDPSDSYTYSSPSFQGHVTISVDKSISTAYLQWSSLKASDTAIYYCARH<br>KENYDFWDFWGQGTLVTVSS |
| 35 | 547 | 547 | YTFTSYWIS |
| 35 | 548 | 548 | TACACCTTTACCAGCTACTGGATCAGT |
| 35 | 549 | 549 | RIDPSDSYTYSSPSFQG |
| 35 | 550 | 550 | AGAATTGATCCGAGTGACTCCTATACCTACTCGAGCCCGTCCTTCCAA<br>GGC |
| 35 | 551 | 551 | ARHKENYDFWDF |
| 35 | 552 | 552 | GCGAGACACAAAGAGAATTACGATTTTTGGGATTTT |
| 35 | 553 | 553 | GAAACGACACTCACGCAGTCTCCAGACTCCCTGGCTGTGTCCCTGGG<br>CGAGAGGGCCACCATCAACTGCAAGTCCAGCCAGACTATTTTCTTCA<br>ACTCCAATAATAAGATCTCCTTAGCTTGGTACCAGCAGAAACCAGGA<br>CAGCCTCCTAAGCTGCTCATTTCCTGGGCATCTACCCGCGAATCCGGG<br>GTCCCTGACCGATTCAGTGGCAGCGGGTCTGGGACAGATTTCACTCTC<br>ACCATCAGCAGCCTGCAGCCTGAGGATGTGGCAGTTTATTTCTGTCAG<br>CAATATTATAGTAGTGCTTTTTTCGGCCCTGGGACACGACTGGAGATT<br>AAA |
| 35 | 554 | 554 | ETTLTQSPDSLAVSLGERATINCKSSQTIFFNSNNKISLAWYQQKPGQPPK<br>LLISWASTRESGVPDRFSGSGSGTDFTLTISSLQPEDVAVYFCQQYYSSAF<br>FGPGTRLEIK |
| 35 | 555 | 555 | KSSQTIFFNSNNKISLA |
| 35 | 556 | 556 | AAGTCCAGCCAGACTATTTTCTTCAACTCCAATAATAAGATCTCCTTA<br>GCT |
| 35 | 557 | 557 | WASTRES |

TABLE 6-continued

Informal Sequence Listing

| Antibody Ref. No. | Seq. Ref. No. | SEQ ID NO. | Sequence |
|---|---|---|---|
| 35 | 558 | 558 | TGGGCATCTACCCGCGAATCC |
| 35 | 559 | 559 | QQYYSSAF |
| 35 | 560 | 560 | CAGCAATATTATAGTAGTGCTTTT |
| 36 | 561 | 561 | CAGGTCCAGCTGGTGCAGTCTGGACCTGAAGTGAAGAAGCCTGGGGC<br>CTCAGTGACGATCTCCTGTCAGGCCTCTGGGTACATCTTCAATCACTA<br>CTCTATCACCTGGGTGCGACAGGCCCCTGGACAAGGGACTGAGTGGA<br>TGGGGTGGATCAGCGCCTATCACGGTAAGACGGAATATTCAGGGAAA<br>TTCCACGGCAGAGTCACCCTGACCACAGACACAGGCACGCGGACAGC<br>CTTCTTGGAACTTAGGGACCTGACATCTGACGACACGGCCATTTATTA<br>TTGTGCGCGAGATGTCCCGGTCATGGGAGCCGCATTTTTGGACTACTG<br>GGGCCAGGGAACCCTGGTCACCGTCTCCTCA |
| 36 | 562 | 562 | QVQLVQSGPEVKKPGASVTISCQASGYIFNHYSITWVRQAPGQGTEWMG<br>WISAYHGKTEYSGKFHGRVTLTTDTGTRTAFLELRDLTSDDTAIYYCAR<br>DVPVMGAAFLDYWGQGTLVTVSS |
| 36 | 563 | 563 | YIFNHYSIT |
| 36 | 564 | 564 | TACATCTTCAATCACTACTCTATCACC |
| 36 | 565 | 565 | WISAYHGKTEYSGKFHG |
| 36 | 566 | 566 | TGGATCAGCGCCTATCACGGTAAGACGGAATATTCAGGGAAATTCCA<br>CGGC |
| 36 | 567 | 567 | ARDVPVMGAAFLDY |
| 36 | 568 | 568 | GCGCGAGATGTCCCGGTCATGGGAGCCGCATTTTTGGACTAC |
| 36 | 569 | 569 | GAAATTGTGTTGACACAGTCTCCACTCTCCCTGCCCGTCACCCTTGGA<br>CAGCCGGCCTCCATCTCCTGCAGGTCTGGTCAAAGTCTCGAATTCAGT<br>GATGGAAACACCTACTTGACTTGGTTTCAGCAGAGGCCAGGCCAATC<br>TCCAAGGCGCCTAATTTTTAGGGGTTCTTACCGGGACTCTGGGGTCCC<br>CGAAAGATTCAGCGGCAGTGGCTCAGGCACTTCTTTCACACTGACAA<br>TCAGCAGGGTGGAGGCTGAGGATGTTGGGATTTATTCTGCATGCAA<br>GGTACACACTGGCCTCCGACGTTCGGCCAAGGGACCAAGCTGGAGAT<br>CAAA |
| 36 | 570 | 570 | EIVLTQSPLSLPVTLGQPASISCRSGQSLEFSDGNTYLTWFQQRPGQSPRR<br>LIFRGSYRDSGVPERFSGSGSGTSFTLTISRVEAEDVGIYFCMQGTHWPPT<br>FGQGTKLEIK |
| 36 | 571 | 571 | RSGQSLEFSDGNTYLT |
| 36 | 572 | 572 | AGGTCTGGTCAAAGTCTCGAATTCAGTGATGGAAACACCTACTTGACT |
| 36 | 573 | 573 | RGSYRDS |
| 36 | 574 | 574 | AGGGGTTCTTACCGGGACTCT |
| 36 | 575 | 575 | MQGTHWPPT |
| 36 | 576 | 576 | ATGCAAGGTACACACTGGCCTCCGACG |
| 37 | 577 | 577 | CAGGTGCAGCTGGTGCAGTCTGGCCCTGCGCTGGTGAAACCCACGCA<br>GACCCTCACACTGACCTGCACCTTCTCTGGGTTCTCACTCACCACTGC<br>AAGAATGTGTGTGAGTTGGATCCGTCAGCCCCCAGGGAAGGCCCTGG<br>AGTGGCTTGCACGCATTGATTGGGATGATGATAAATCCTACAGCACA<br>TCTCTGAAGACCAGGCTCACCATCGCCAAGGACACATCCAAAACCA<br>GGTCGTCCTTACCATGACCAACATGGGCCCCGCGGACACAGCCACTT<br>ATTACTGTGTACGGACTCCTATATATGCTAGTGGTGGTTATTACCTCT<br>CCTACTTTGACTCCTGGGGCCAGGGAACCCTGGTCACCGTCTCCTCA |
| 37 | 578 | 578 | QVQLVQSGPALVKPTQTLTLTCTFSGFSLTTARMCVSWIRQPPGKALEW<br>LARIDWDDDKSYSTSLKTRLTIAKDTSKNQVVLTMTNMGPADTATYYC<br>VRTPIYASGGYYLSYFDSWGQGTLVTVSS |
| 37 | 579 | 579 | FSLTTARMCVS |
| 37 | 580 | 580 | TTCTCACTCACCACTGCAAGAATGTGTGTGAGT |

TABLE 6-continued

Informal Sequence Listing

| Antibody No. | Seq. Ref. No. | SEQ ID NO. | Sequence |
|---|---|---|---|
| 37 | 581 | 581 | RIDWDDDKSYSTSLKT |
| 37 | 582 | 582 | CGCATTGATTGGGATGATGATAAATCCTACAGCACATCTCTGAAGACC |
| 37 | 583 | 583 | VRTPIYASGGYYLSYFDS |
| 37 | 584 | 584 | GTACGGACTCCTATATATGCTAGTGGTGGTTATTACCTCTCCTACTTT GACTCC |
| 37 | 585 | 585 | GATATTGTGATGACGCAGTCTCCATCCTCCCTGTCTGCATCTGTCGGA GACAGCGTCACCATCACTTGCCGGGCAAGTCAGACTATTGCCAGCTA TGTGAATTGGTATCAGCACAAACCAGGGCAAGCCCCTAACCTCCTGA TCTATGCTGCATCCATTTTGCACAGTGGGGTCCCATCAAGGTTCAGAG GCGGTGGCTCTGGGACAGATTTCACTCTCACCATCAACAGTCTGCAAC CTGAAGATTTTGCAACTTACTACTGTCAACAGAGTTACAGTACCCCTT ACACTTTTGGCCAGGGGACCAAAGTGGATATCAAA |
| 37 | 586 | 586 | DIVMTQSPSSLSASVGDSVTITCRASQTIASYVNWYQHKPGQAPNLLIYA ASILHSGVPSRFRGGGSGTDFTLTINSLQPEDFATYYCQQSYSTPYTFGQG TKVDIK |
| 37 | 587 | 587 | RASQTIASYVN |
| 37 | 588 | 588 | CGGGCAAGTCAGACTATTGCCAGCTATGTGAAT |
| 37 | 589 | 589 | AASILHS |
| 37 | 590 | 590 | GCTGCATCCATTTTGCACAGT |
| 37 | 591 | 591 | QQSYSTPYT |
| 37 | 592 | 592 | CAACAGAGTTACAGTACCCCTTACACT |
| 38 | 593 | 593 | CAGGTGCAGCTGGTGGAGTCTGGTCCTACGCTGGTGAAACCCACACA GACCCTCTCGCTGACCTGCACCTTCTCTGGGTTCTCACTCACCACTCG TGGAGTGGGTGTGGGCTGGATCCGTCAGCCCCCAGGAAAGGCCCTGG AGTGGCTTGGATTCACTTATTGGGATGGTGATGACCGCTACAGCCCAT CTCTGAGGAACAGAGTCTCCATCGCCAAGGACACCTCCAAAAACCAG GTGGTCCTTACACTGACCAACATGGACCCTGTGGACACAGCCACGTA TTTTTGTGTACACAGCGATCGCTATGACAGGGGTGGTTATTACTTATA CTTCTTTGACTACTGGGGCCCGGGAACCCTGGTCACCGTCTCCTCA |
| 38 | 594 | 594 | QVQLVESGPTLVKPTQTLSLTCTFSGFSLTTRGVGVGWIRQPPGKALEWL GFTYWDGDDRYSPSLRNRVSIAKDTSKNQVVLTLTNMDPVDTATYFCV HSDRYDRGGYYLYFFDYWGPGTLVTVSS |
| 38 | 595 | 595 | FSLTTRGVGVG |
| 38 | 596 | 596 | TTCTCACTCACCACTCGTGGAGTGGGTGTGGGC |
| 38 | 597 | 597 | FTYWDGDDRYSPSLRN |
| 38 | 598 | 598 | TTCACTTATTGGGATGGTGATGACCGCTACAGCCCATCTCTGAGGAAC |
| 38 | 599 | 599 | VHSDRYDRGGYYLYFFDY |
| 38 | 600 | 600 | GTACACAGCGATCGCTATGACAGGGGTGGTTATTACTTATACTTCTTT GACTAC |
| 38 | 601 | 601 | GACATCCGAGTCACCCAGTCTCCATCCTCCCTGTCTGCGTCTGTGGGG GACAGAGTCTCCATCAGTTGCCGGGCAAGTCAGACCATTGCCAGTTA TGTAAATTGGTATCAGCAGAGACCAGGGAAAGCCCCTCAACTCCTGA TCTTTGCTGCATCCCATTTGCAGACTGGGGTCCCATCAAGATTCAGTG GCAGGGGCTCTGGGACAGATTTCACTCTCACCATCACCTCTCTGCAAC CTGAAGATTTTGCAACTTACTACTGTCAACAGAGTTACACTTCCCCGT ACACTTTTGGCCAGGGGACCAAGGTGGAAATCAAA |
| 38 | 602 | 602 | DIRVTQSPSSLSASVGDRVSISCRASQTIASYVNWYQQRPGKAPQLLIFAA SHLQTGVPSRFSGRGSGTDFTLTITSLQPEDFATYYCQQSYTSPYTFGQGT KVEIK |
| 38 | 603 | 603 | RASQTIASYVN |

TABLE 6-continued

Informal Sequence Listing

| Antibody No. | Seq. Ref. No. | SEQ ID NO. | Sequence |
|---|---|---|---|
| 38 | 604 | 604 | CGGGCAAGTCAGACCATTGCCAGTTATGTAAAT |
| 38 | 605 | 605 | AASHLQT |
| 38 | 606 | 606 | GCTGCATCCCATTTGCAGACT |
| 38 | 607 | 607 | QQSYTSPYT |
| 38 | 608 | 608 | CAACAGAGTTACACTTCCCCGTACACT |
| 39 | 609 | 609 | GAGGTGCAGCTGGTGGAGTCTGGTCCTACGCTGGTGAAACCCACACA GACCCTCACGCTGACCTGCTCCCTCTCTGGGTTCTCACTCACCACTCG TGGGGTGGGTGTGGGCTGGATCCGCCAGCCCCCAGGAAAGGCCCCGG AGTGCCTTGGATTCGTTTATTGGGATGATGATAACCGCTACAGCCCAT CTCTGAGGGGCAGACTCACCATCTCCAAGGACACGTCCAAGAACCAG GTGGTCCTTACACTGACCAACATGGACCCTTTGGACACAGCCACCTAT TACTGTGTTCACAGCGATCTCTATGATAGAGGTGGTTATTACTTATTC TACTTTGACGACTGGGGCCAGGGAACCCTGGTCACCGTCTCCTCA |
| 39 | 610 | 610 | EVQLVESGPTLVKPTQTLTLTCSLSGFSLTTRGVGVGWIRQPPGKAPECL GFVYWDDDNRYSPSLRGRLTISKDTSKNQVVLTLTNMDPLDTATYYCV HSDLYDRGGYYLFYFDDWGQGTLVTVSS |
| 39 | 611 | 611 | FSLTTRGVGVG |
| 39 | 612 | 612 | TTCTCACTCACCACTCGTGGGGTGGGTGTGGGC |
| 39 | 613 | 613 | FVYWDDDNRYSPSLRG |
| 39 | 614 | 614 | TTCGTTTATTGGGATGATGATAACCGCTACAGCCCATCTCTGAGGGGC |
| 39 | 615 | 615 | VHSDLYDRGGYYLFYFDD |
| 39 | 616 | 616 | GTTCACAGCGATCTCTATGATAGAGGTGGTTATTACTTATTCTACTTT GACGAC |
| 39 | 617 | 617 | GACATCCAGGTGACCCAGTCTCCATCCTCCCTGTCTGCATCTGTGGGG GACAGAGTCACCATCACTTGCCGGGCAAGTCAGCCCATTGCCAGTTA TTTAAAATTGGTATCAGCAGAAACCAGGGCAAGCCCCTAAACTCCTCA TCTATGCTGCATCCATGTTGCAGAGTGGGGCCCATCAAAATTCAGTG GCCGGGGATCTGGGACAGATTTCACTCTCACCATCACCACTCTACAAC CTGAAGATTTTGCAACTTACTACTGTCAACAGAGTTACACTTTCCCGT ACACTTTTGGCCAGGGGACCAAGGTGGAAATCAAA |
| 39 | 618 | 618 | DIQVTQSPSSLSASVGDRVTITCRASQPIASYLNWYQQKPGQAPKLLIYA ASMLQSGAPSKFSGRGSGTDFTLTITTLQPEDFATYYCQQSYTFPYTFGQ GTKVEIK |
| 39 | 619 | 619 | RASQPIASYLN |
| 39 | 620 | 620 | CGGGCAAGTCAGCCCATTGCCAGTTATTTAAAT |
| 39 | 621 | 621 | AASMLQS |
| 39 | 622 | 622 | GCTGCATCCATGTTGCAGAGT |
| 39 | 623 | 623 | QQSYTFPYT |
| 39 | 624 | 624 | CAACAGAGTTACACTTTCCCGTACACT |
| 40 | 625 | 625 | GAGGTGCAGCTGGTGGAGTCTGGGGGAGGCTTGGTCAAGCCTGGAGG GTCCCTGAGACTCTCCTGTGCAGCCTCTGGATTCACCTTCAGTGACTA CTACATGAGCTGGATCCGCCAGGCTCCAGGGAAGGGACTGGAGTGGG TTTCATATATTAGTATTAGTAGTAGTTACACAGACTACGCAGACTCTG TGAAGGGCCGATTCACCATCTCCAGAGACAACGCCAAGAACTCACTG TATCTGCAAATGAACAGCCTGAGAGCCGAGGACACGGCCGTGTATTA CTGTGCGAGAGATCAACGAGACCAAGCAGTGGCTGGTCGGTGGTTCG ACCCCTGGGGCCAGGGAACCCTGGTCACCGTCTCCTCA |
| 40 | 626 | 626 | EVQLVESGGGLVKPGGSLRLSCAASGFTFSDYYMSWIRQAPGKGLEWVS YISISSSYTDYADSVKGRFTISRDNAKNSLYLQMNSLRAEDTAVYYCARD QRDQAVAGRWFDPWGQGTLVTVSS |
| 40 | 627 | 627 | FTFSDYYMS |

TABLE 6-continued

Informal Sequence Listing

| Antibody No. | Seq. Ref. No. | SEQ ID NO. | Sequence |
|---|---|---|---|
| 40 | 628 | 628 | TTCACCTTCAGTGACTACTACATGAGC |
| 40 | 629 | 629 | YISISSSYTDYADSVKG |
| 40 | 630 | 630 | TATATTAGTATTAGTAGTAGTTACACAGACTACGCAGACTCTGTGAAGGGC |
| 40 | 631 | 631 | ARDQRDQAVAGRWFDP |
| 40 | 632 | 632 | GCGAGAGATCAACGAGACCAAGCAGTGGCTGGTCGGTGGTTCGACCCC |
| 40 | 633 | 633 | CAGTCTGTGGTGACGCAGCCGCCCTCAGTGTCTGGGGCCCCAGGGCAGAGGGTCACCATCTCCTGCACTGGGAGCAGCTCCAACATCGGGGCAGGTTTTGATGTACACTGGTACCAGCAGGTTCCAGGAACAGCCCCCAAACTCCTCATCTATGCTAACACCAATCGGCCCTCAGGGGTCCCAGACCGATTCTCTGGCTCCAAGTCTGGCACCTCAGCCTCCCTGGCCATCACTGGGCTCAAGGCTGAGGATGAGGCTGATTATTACTGCCAGTCCTATGACAACAGCCTGAGTGGTTCGGCGGTCTTCGGCGGAGGGACCAAGGTCACCGTCCTA |
| 40 | 634 | 634 | QSVVTQPPSVSGAPGQRVTISCTGSSSNIGAGFDVHWYQQVPGTAPKLLIYANTNRPSGVPDRFSGSKSGTSASLAITGLKAEDEADYYCQSYDNSLSGSAVFGGGTKVTVL |
| 40 | 635 | 635 | TGSSSNIGAGFDVH |
| 40 | 636 | 636 | ACTGGGAGCAGCTCCAACATCGGGGCAGGTTTTGATGTACAC |
| 40 | 637 | 637 | ANTNRPS |
| 40 | 638 | 638 | GCTAACACCAATCGGCCCTCA |
| 40 | 639 | 639 | QSYDNSLSGSAV |
| 40 | 640 | 640 | CAGTCCTATGACAACAGCCTGAGTGGTTCGGCGGTC |
| 41 | 641 | 641 | CAGGTGCAGCTGGTGCAATCTGGTTCTGAGGTGAAGCAGCCTGGGGCCTCAGTGAAGGTCTCCTGCAAGGCCTCTGGATACACCTTCAGCGCCTACCATCTGCACTGGGTGCGCCAGGCCCCCGGACAAGGGCTTCAGTGGCTGGGCAGGATCAACCCTAACAGTGGTGCCACAAGCGTTGCACATAACTTTCAGGGCAGGGTCACCTTGACCACGGACACGTCCATCAGCACAGCCTACATGGAGCTGAGCAGCCTGACGTCTGACGACAGTGCCGTGTATTACTGCGCGAGAACTATGTGGCGGTGGCTGGTCGAGGGGGGCTTTGAGAACTGGGGCCAGGGAACCCTGGTCACCGTCTCCTCA |
| 41 | 642 | 642 | QVQLVQSGSEVKQPGASVKVSCKASGYTFSAYHLHWVRQAPGQGLQWLGRINPNSGATSVAHNFQGRVTLTTDTSISTAYMELSSLTSDDSAVYYCARTMWRWLVEGGFENWGQGTLVTVSS |
| 41 | 643 | 643 | YTFSAYHLH |
| 41 | 644 | 644 | TACACCTTCAGCGCCTACCATCTGCAC |
| 41 | 645 | 645 | RINPNSGATSVAHNFQG |
| 41 | 646 | 646 | AGGATCAACCCTAACAGTGGTGCCACAAGCGTTGCACATAACTTTCAGGGC |
| 41 | 647 | 647 | ARTMWRWLVEGGFEN |
| 41 | 648 | 648 | GCGAGAACTATGTGGCGGTGGCTGGTCGAGGGGGGCTTTGAGAAC |
| 41 | 649 | 649 | GACATCCGGATGACCCAGTCTCCACTCTCCCTGCCCGTCACCCCTGGAGAGCCGGCCTCCATCTCCTGCAGGTCTAGTCAGAGCCTCCTGCATAGTAATGGAGACAACTATTTGGATTGGTACCTGCAGAAGCCAGGGCAGTCTCCACAGGTCCTGATCTATCTGGGTTCTAATCGGGCCTCCGGGGTCCCTGACAGGTTCAGTGGCAGTGGATCAGGCACAGATTTTACACTGAAAATCAGCAGAGTGGAGGCTGAGGATGTTGGGGTTTATTACTGCATGCAAGCTCTACAAACTCCGCTCACTTTCGGCGGAGGGACCAAGGTGGAAATCAAA |

TABLE 6-continued

Informal Sequence Listing

| Antibody No. | Seq. Ref. No. | SEQ ID NO. | Sequence |
|---|---|---|---|
| 41 | 650 | 650 | DIRMTQSPLSLPVTPGEPASISCRSSQSLLHSNGDNYLDWYLQKPGQSPQ VLIYLGSNRASGVPDRFSGSGSGTDFTLKISRVEAEDVGVYYCMQALQTP LTFGGGTKVEIK |
| 41 | 651 | 651 | RSSQSLLHSNGDNYLD |
| 41 | 652 | 652 | AGGTCTAGTCAGAGCCTCCTGCATAGTAATGGAGACAACTATTTGGAT |
| 41 | 653 | 653 | LGSNRAS |
| 41 | 654 | 654 | CTGGGTTCTAATCGGGCCTCC |
| 41 | 655 | 655 | MQALQTPLT |
| 41 | 656 | 656 | ATGCAAGCTCTACAAACTCCGCTCACT |
| 42 | 657 | 657 | CAGGTCCAGCTGGTGCAGTCTGGGGCTGAGGTGAAGAAGCCGGGGTC CTCGATGAGCATCTCCTGTCGGGCTTCTGGAGGCTCCTTCAACAACCA AGCTATACACTGGATCCGCCAGGCCCCTGGAGAAGGACTTGAGTGGA TGGGAAATATCATCCCTAATTTCGGATCTCAAAACTACGCGCCGGAA TTCGTGGGCAGGGTCAGCTTCAATGCGGACGCTTCCGCTGGCACTGCC TACATGGACTTGAGTGATCTGACATCTCAAGACACGGCCGTCTATTAC TGTGCGACAGCCGGGTGGTTCGGGGAATTGGTGCGCTTTGACTCCTG GGGCCAGGGAACCCTGGTCACCGTCTCCTCA |
| 42 | 658 | 658 | QVQLVQSGAEVKKPGSSMSISCRASGGSFNNQAIHWIRQAPGEGLEWMG NIIPNFGSQNYAPEFVGRVSFNADASAGTAYMDLSDLTSQDTAVYYCAT AGWFGELVRFDSWGQGTLVTVSS |
| 42 | 659 | 659 | GSFNNQAIH |
| 42 | 660 | 660 | GGCTCCTTCAACAACCAAGCTATACAC |
| 42 | 661 | 661 | NIIPNFGSQNYAPEFVG |
| 42 | 662 | 662 | AATATCATCCCTAATTTCGGATCTCAAAACTACGCGCCGGAATTCGTG GGC |
| 42 | 663 | 663 | ATAGWFGELVRFDS |
| 42 | 664 | 664 | GCGACAGCCGGGTGGTTCGGGGAATTGGTGCGCTTTGACTCC |
| 42 | 665 | 665 | GATATTGTGATGACGCAGTCTCCAGCCACCCTGTCTGTGTCTCCAGGG GGAAGGGCCACCCTCTCCTGCAGGGCCAGTGAGACTATTACCACTAA CTTAGCCTGGTACCAGCAGAAGCCTGGCCAGGCTCCCAGGCTCCTCA TCTATGGTGCGTCCACCAGGGCCACTGGTATCCCAGCCAGGTTCAGTG GCAGTGGGTCAGGGACAGAGTTCACTCTCACCATCAACAGCCTGCAG TCTGAGGATTTTGCAGTTTATTACTGTCAGCAGTATAATAACTGGCCT CCTCTCACTTTCGGCGGAGGGACCAAGCTGGAGATCAAA |
| 42 | 666 | 666 | DIVMTQSPATLSVSPGGRATLSCRASETITTNLAWYQQKPGQAPRLLIYG ASTRATGIPARFSGSGSGTEFTLTINSLQSEDFAVYYCQQYNNWPPLTFG GGTKLEIK |
| 42 | 667 | 667 | RASETITTNLA |
| 42 | 668 | 668 | AGGGCCAGTGAGACTATTACCACTAACTTAGCC |
| 42 | 669 | 669 | GASTRAT |
| 42 | 670 | 670 | GGTGCGTCCACCAGGGCCACT |
| 42 | 671 | 671 | QQYNNWPPLT |
| 42 | 672 | 672 | CAGCAGTATAATAACTGGCCTCCTCTCACT |
| 43 | 673 | 673 | CAGGTGCAGCTACAGCAGTGGGGCGCAGGACTGGTGAAGCCTTCGGA GACCCTGTCCCTCACCTGCGCTGTGTCTGGTGGGTCCTTCAGGGGTTA CCAGTGGAACTGGTTCCGCCAGCCCCCGGGAAGGGTCTGGAGTGGA TTGGGGAAATCAATCATGGTGAATACACCCACTACAACGCGTCCCTC AAGAGTCGCGTCAGTTTATCTATAGACACGTCCAAGAACCAGTTCTCC CTTAATCTGACCTCTGTGACCGCCGCGGACACGGCTATGTATTTTTGT |

TABLE 6-continued

Informal Sequence Listing

| Antibody No. | Seq. Ref. No. | SEQ ID NO. | Sequence |
|---|---|---|---|
| | | | GCGAGAGCCTCGAGTGGGACCTATAACTTCGAGTACTGGTTCGACCCC CTGGGGCCAGGGAACCCTGGTCACCGTCTCCTCA |
| 43 | 674 | 674 | QVQLQQWGAGLVKPSETLSLTCAVSGGSFRGYQWNWFRQPPGKGLEWI GEINHGEYTHYNASLKSRVSLSIDTSKNQFSLNLTSVTAADTAMYFCARA SSGTYNFEYWFDPWGQGTLVTVSS |
| 43 | 675 | 675 | GSFRGYQWN |
| 43 | 676 | 676 | GGGTCCTTCAGGGGTTACCAGTGGAAC |
| 43 | 677 | 677 | EINHGEYTHYNASLKS |
| 43 | 678 | 678 | GAAATCAATCATGGTGAATACACCCACTACAACGCGTCCCTCAAGAGT |
| 43 | 679 | 679 | ARASSGTYNFEYWFDP |
| 43 | 680 | 680 | GCGAGAGCCTCGAGTGGGACCTATAACTTCGAGTACTGGTTCGACCCC |
| 43 | 681 | 681 | TCCTATGTGCTGACACAGCCACCCTCGGTGTCAGTGGCCCCAGGAAA GACGGCCTGGCTTACCTGTGGGGGAAACAACATTGGAAATAAAAGAG TGCACTGGTACCAGCAGAAGCCAGGCCAGGCCCCTGTGCTGGTCGTG TATGATGATTACGGCCGGCCCTCAGGGACCTCTGAGCGAGTCTCTGG CTCCAACTCTGGGAACACGGCCACCCTGACCATCAGCAGGGTCGAAG CCGGGGATGAGGCCGAGTATTATTGTCAGGTGTGGGATGATCCCAGT GATCATGCGGTGTTCGGCGGAGGCACCCAGCTGACCGTCCTC |
| 43 | 682 | 682 | SYVLTQPPSVSVAPGKTAWLTCGGNNIGNKRVHWYQQKPGQAPVLVVY DDYGRPSGTSERVSGSNSGNTATLTISRVEAGDEAEYYCQVWDDPSDHA VFGGGTQLTVL |
| 43 | 683 | 683 | GGNNIGNKRVH |
| 43 | 684 | 684 | GGGGGAAACAACATTGGAAATAAAAGAGTGCAC |
| 43 | 685 | 685 | DDYGRPS |
| 43 | 686 | 686 | GATGATTACGGCCGGCCCTCA |
| 43 | 687 | 687 | QVWDDPSDHAV |
| 43 | 688 | 688 | CAGGTGTGGGATGATCCCAGTGATCATGCGGTG |
| 44 | 689 | 689 | CAGGTCCAGCTGGTGCAGTCTGGGGGACGACTGGTCAAGCCTGGGGG GTCCCTGAGACTCTCCTGTGGAATGTCTGGATTCGGCTTCAGTAGTTA TAGAATGAATTGGGTCCGCCAGGCTCCAGGGAAGGGACTGGAGTGGA TCTCATCGATTAGTGCTAGTAGTAGTTATACAGACTACGCGAATTCAG TGAAGGGCCGATTCACCATCTCCAGAGACGGCGCCAATTTGTTTCTGC AAATGAACAGCCTGAGAGTCGAGGACACGGCTGTGTATTATTGTGCG AGAGATTGGGGGGGACATTCCATTTTTGGAGCGGTCCAAGACCTCTG GGGCCAGGGAACCCTGGTCACCGTCTCCTCA |
| 44 | 690 | 690 | QVQLVQSGGRLVKPGGSLRLSCGMSGFGFSSYRMNWVRQAPGKGLEWI SSISASSSYTDYANSVKGRFTISRDGANLFLQMNSLRVEDTAVYYCARD WGGHSIFGAVQDLWGQGTLVTVSS |
| 44 | 691 | 691 | FGFSSYRMN |
| 44 | 692 | 692 | TTCGGCTTCAGTAGTTATAGAATGAAT |
| 44 | 693 | 693 | SISASSSYTDYANSVKG |
| 44 | 694 | 694 | TCGATTAGTGCTAGTAGTAGTTATACAGACTACGCGAATTCAGTGAA GGGC |
| 44 | 695 | 695 | ARDWGGHSIFGAVQDL |
| 44 | 696 | 696 | GCGAGAGATTGGGGGGGACATTCCATTTTTGGAGCGGTCCAAGACCTC |
| 44 | 697 | 697 | CAGTCTGTGCTGACGCAGCCGCCCTCAGTGTCTGGGGCCCTGGGCA GAGGGTCACCATCTCCTGCTCTGGGAGCAGTTCCAACATCGGGGCAG GTTATGATGTCCACTGGTACCAGCAGCTTCCAGGAACAGCCCCCAAA CTCCTCATCTATGGTAACACCAATCGGCCCTCAGGGGTCCCTGACCGA TTCTCTGGCTCCAAGTCTGGCACGTCAGCCTCCCTGGCCATCACTGGC |

TABLE 6-continued

Informal Sequence Listing

| Antibody Ref. No. | Seq. Ref. No. | SEQ ID NO. | Sequence |
|---|---|---|---|
| | | | CTCCAGGCCGAGGATGAGGCTGATTATTACTGCCAGTCCTATGACAG<br>AAGCCTGAGTCAGGTCTTCGGAGCTGGGACCAAGGTGACCGTCCTA |
| 44 | 698 | 698 | QSVLTQPPSVSGAPGQRVTISCSGSSSNIGAGYDVHWYQQLPGTAPKLLI<br>YGNTNRPSGVPDRFSGSKSGTSASLAITGLQAEDEADYYCQSYDRSLSQV<br>FGAGTKVTVL |
| 44 | 699 | 699 | SGSSSNIGAGYDVH |
| 44 | 700 | 700 | TCTGGGAGCAGTTCCAACATCGGGGCAGGTTATGATGTCCAC |
| 44 | 701 | 701 | GNTNRPS |
| 44 | 702 | 702 | GGTAACACCAATCGGCCCTCA |
| 44 | 703 | 703 | QSYDRSLSQV |
| 44 | 704 | 704 | CAGTCCTATGACAGAAGCCTGAGTCAGGTC |
| 45 | 705 | 705 | CAGGTCACCTTGAAGGAGTCTGGTCCTGCGCTGGTGAGACCCAAACA<br>GACCCTCACTCTGACCTGCTCCTTCTCCGGCTTCTCACTCGACACTCA<br>AAGAACGGGTGTGAATTGGATCCGTCAGTCCCCAGGGAAGGCCCTGG<br>AGTGGCTTGCACGGATTGATTGGGATGGCAATATTTACTCCAGCACCT<br>CTGTGAGGACCAAACTCAGCATCTCCAAGGGCACCTCCAAAAACCAG<br>GTGGTCCTTACAATGACCGACGTGGACCCTGTGGACACAGCCACCTA<br>TTACTGTGCACGGACTCTTTACTATACTTCTGGTGGTTATTACTTGAAC<br>CTCTTTGACTACTGGGGCCAAGGAACCCTGGTCACCGTCTCCTCA |
| 45 | 706 | 706 | QVTLKESGPALVRPKQTLTLTCSFSGFSLDTQRTGVNWIRQSPGKALEWL<br>ARIDWDGNIYSSTSVRTKLSISKGTSKNQVVLTMTDVDPVDTATYYCAR<br>TLYYTSGGYYLNLFDYWGQGTLVTVSS |
| 45 | 707 | 707 | FSLDTQRTGVN |
| 45 | 708 | 708 | TTCTCACTCGACACTCAAAGAACGGGTGTGAAT |
| 45 | 709 | 709 | RIDWDGNIYSSTSVRT |
| 45 | 710 | 710 | CGGATTGATTGGGATGGCAATATTTACTCCAGCACCTCTGTGAGGACC |
| 45 | 711 | 711 | ARTLYYTSGGYYLNLFDY |
| 45 | 712 | 712 | GCACGGACTCTTTACTATACTTCTGGTGGTTATTACTTGAACCTCTTTG<br>ACTAC |
| 45 | 713 | 713 | GAAATTGTGATGACGCAGTCTCCACCCTCCCTGTCTGCCTCTGTTGGG<br>GACAGAGTCACCATCACTTGCCGGGCAAGTCAGACAATTCCCAGCTA<br>TGTCAATTGGTATCAGCAGATATCAGGGAAAGCCCCTCGCCTCCTGAT<br>CTATGCTGCCTCACTTTTGCAAAGTGGGGTCCCATCAAGGTTCAGTGG<br>CAGCGGATCTGGGACAGAGTTCAGTCTCACCATCAGCGGTCTGCGAC<br>CTGAGGATTTTGGCACTTACTACTGTCAACAGAGTTACAGTTCCACTC<br>CCACTTTCGGCCAGGGGACACGACTGGAGATTAAA |
| 45 | 714 | 714 | EIVMTQSPPSLSASVGDRVTITCRASQTIPSYVNWYQQISGKAPRLLIYAA<br>SLLQSGVPSRFSGSGSGTEFSLTISGLRPEDFGTYYCQQSYSSTPTFGQGTR<br>LEIK |
| 45 | 715 | 715 | RASQTIPSYVN |
| 45 | 716 | 716 | CGGGCAAGTCAGACAATTCCCAGCTATGTCAAT |
| 45 | 717 | 717 | AASLLQS |
| 45 | 718 | 718 | GCTGCCTCACTTTTGCAAAGT |
| 45 | 719 | 719 | QQSYSSTPT |
| 45 | 720 | 720 | CAACAGAGTTACAGTTCCACTCCCACT |
| 46 | 721 | 721 | GAGGTGCAGCTGGTGGAGTCTGGGGCTGAGGTGAAGAGGCCTGGGTC<br>CTCGGTGAAGGTCTCCTGTAAGGTTGTCGGAGGCAGTTTCAGCAACT<br>ATGCTATCAGCTGGGTGCGACAGGCCCCTGGACAAGGGCCTGAGTAT<br>CTGGGAGGGATCATCCCCGCCTTTAGGACAGCAAAATATGCAAAGAA<br>ATTCCAGGACAGACTCACAATTACCGCGGACGAATCTACGAGCACTG |

TABLE 6-continued

Informal Sequence Listing

| Antibody No. | Seq. Ref. No. | SEQ ID NO. | Sequence |
|---|---|---|---|
| | | | CCTACATGGAAATGAGGGGCCTGACATCTGACGACACGGGCCTATAT TATTGTGCGAGGCCTGAAGGAGACTTTGGGGATTTGAAGTGGCTACG ATCGCCCTTTGACTACTGGGGCCAGGGAACCCTGGTCACCGTCTCCTCA |
| 46 | 722 | 722 | EVQLVESGAEVKRPGSSVKVSCKVVGGSFSNYAISWVRQAPGQGPEYLG GIIPAFRTAKYAKKFQDRLTITADESTSTAYMEMRGLTSDDTGLYYCARP EGDFGDLKWLRSPFDYWGQGTLVTVSS |
| 46 | 723 | 723 | GSFSNYAIS |
| 46 | 724 | 724 | GGCAGTTTCAGCAACTATGCTATCAGC |
| 46 | 725 | 725 | GIIPAFRTAKYAKKFQD |
| 46 | 726 | 726 | GGGATCATCCCCGCCTTTAGGACAGCAAAATATGCAAAGAAATTCCA GGAC |
| 46 | 727 | 727 | ARPEGDFGDLKWLRSPFDY |
| 46 | 728 | 728 | GCGAGGCCTGAAGGAGACTTTGGGGATTTGAAGTGGCTACGATCGCC CTTTGACTAC |
| 46 | 729 | 729 | GAAATTGTGTTGACGCAGTCTCCAGCCACCCTGTCTGTGTCTCCAGGG CAAAGAGTCACCCTTTCCTGCAGGGCCAGTCAGGGTGTGAGCATCAA CTTAGCCTGGTACCAGCAGAAACCTGGCCAGCCTCCCAGGCTCCTCAT CTATGGTGCATCCACCCGGGCCACTGATATCCCAGCCAGGTTCAGTG GCAGTGGGTCTGGGACAGACTTCACTCTCACCATCAGCAGCCTGCAG TCTGAAGATTTTGCAGTTTATTATTGTCAGCAGTATGATGACTGGCCT CCCCAGCTCACTTTCGGCCCTGGGACCAAGCTGGAGATCAAA |
| 46 | 730 | 730 | EIVLTQSPATLSVSPGQRVTLSCRASQGVSINLAWYQQKPGQPPRLLIYG ASTRATDIPARFSGSGSGTDFTLTISSLQSEDFAVYYCQQYDDWPPQLTF GPGTKLEIK |
| 46 | 731 | 731 | RASQGVSINLA |
| 46 | 732 | 732 | AGGGCCAGTCAGGGTGTGAGCATCAACTTAGCC |
| 46 | 733 | 733 | GASTRAT |
| 46 | 734 | 734 | GGTGCATCCACCCGGGCCACT |
| 46 | 735 | 735 | QQYDDWPPQLT |
| 46 | 736 | 736 | CAGCAGTATGATGACTGGCCTCCCCAGCTCACT |
| 47 | 737 | 737 | CAGGTGCAGCTGCAGGAGTCGGGCCCAGGACTAGTGAAGCCTTCGGA GACCCTGTCCCTCACCTGCACTGTCTCTGGTGGCTCCATCAATAACTA CTTCTGGAGCTGGATCCGGCAGCCCCCAGGGAAGGGACTGGAGTGGC TTGGATATATCTACAACAGTGGGAGCACCTACTACAACCCCTCCCTCA ACAGTCGAGTCACCATCTCATTACAAAAGTCCAAGAACCAGTTCTCC CTGCACCTGACGTCCATGACCGCCGCCGATACGGCCGTGTATTTCTGT GCGAGACATCCAAGTGTGATCTACGGGACTTTCGGCGCAACGGGGG GCCAAACTGGTTCGACCCCTGGGGCCAGGGAACCCTGGTCACCGTCT CCTCA |
| 47 | 738 | 738 | QVQLQESGPGLVKPSETLSLTCTVSGGSINNYFWSWIRQPPGKGLEWLG YIYNSGSTYYNPSLNSRVTISLQKSKNQFSLHLTSMTAADTAVYFCARHP SVIYGTFGANGGPNWFDPWGQGTLVTVSS |
| 47 | 739 | 739 | GSINNYFWS |
| 47 | 740 | 740 | GGCTCCATCAATAACTACTTCTGGAGC |
| 47 | 741 | 741 | YIYNSGSTYYNPSLNS |
| 47 | 742 | 742 | TATATCTACAACAGTGGGAGCACCTACTACAACCCCTCCCTCAACAGT |
| 47 | 743 | 743 | ARHPSVIYGTFGANGGPNWFDP |
| 47 | 744 | 744 | GCGAGACATCCAAGTGTGATCTACGGGACTTTCGGCGCAACGGGGG GCCAAACTGGTTCGACCCC |

TABLE 6-continued

Informal Sequence Listing

| Antibody No. | Seq. Ref. No. | SEQ ID NO. | Sequence |
|---|---|---|---|
| 47 | 745 | 745 | CAGTCTGTTCTGACTCAGCCTGCCTCCGTGTCTGGGTCTCCTGGACAG<br>TCGATCACCATCTCCTGCACTGGAACCAGCAGTGACGTTGGTGGTTAT<br>AACTATGTCTCCTGGTACCAACAACACCCAGGCAAGGCCCCCAAACT<br>CATGATTTTCGATGTCACTTATCGGCCCTCAGGGATTTCTAATCGCTT<br>CTCTGGCTCCAAGTCTGGCAACACGGCCTCCCTGACCATCTCTGGGCT<br>CCACTCTGAGGACGAGGCTGATTATTATTGCAGCTCATATACAGGCA<br>GCAACACCGTGATTTTCGGCGGAGGGACCAAGCTGACCGTCCTA |
| 47 | 746 | 746 | QSVLTQPASVSGSPGQSITISCTGTSSDVGGYNYVSWYQQHPGKAPKLMI<br>FDVTYRPSGISNRFSGSKSGNTASLTISGLHSEDEADYYCSSYTGSNTVIF<br>GGGTKLTVL |
| 47 | 747 | 747 | TGTSSDVGGYNYVS |
| 47 | 748 | 748 | ACTGGAACCAGCAGTGACGTTGGTGGTTATAACTATGTCTCC |
| 47 | 749 | 749 | DVTYRPS |
| 47 | 750 | 750 | GATGTCACTTATCGGCCCTCA |
| 47 | 751 | 751 | SSYTGSNTVI |
| 47 | 752 | 752 | AGCTCATATACAGGCAGCAACACCGTGATT |
| 48 | 753 | 753 | CAGGTCCAGCTTGTACAGTCTGGGGCTGAAGTGAAGAAGCCTGGGGC<br>CTCAGTGAGGGTCTCCTGCAAGGCTTCTGGCTACACCTTCAGCAGCTA<br>CTATATTCACTGGGTGCGACAGGCCCCTGGACAAGGGCCTGAGTGGC<br>TGGGATGGATCAACCCAAAGAGTGGTGACACAATCTATTCATATAAG<br>TTTCAGGGCAGGGTCACCTTGACCAGGGAAACGTCAATCACCACAGC<br>CTACATGGAGTTGACCAGTCTGAGATCTGACGACACGGCCGTCTATT<br>ACTGTGCGCGAGTTACTTGGCAGTGGCTGGTCCTGGGGGGTTTTGACT<br>ACTGGGGCCAGGGAACCCTGGTCACCGTCTCCTCA |
| 48 | 754 | 754 | QVQLVQSGAEVKKPGASVRVSCKASGYTFSSYYIHWVRQAPGQGPEWL<br>GWINPKSGDTIYSYKFQGRVTLTRETSITTAYMELTSLRSDDTAVYYCAR<br>VTWQWLVLGGFDYWGQGTLVTVSS |
| 48 | 755 | 755 | YTFSSYYIH |
| 48 | 756 | 756 | TACACCTTCAGCAGCTACTATATTCAC |
| 48 | 757 | 757 | WINPKSGDTIYSYKFQG |
| 48 | 758 | 758 | TGGATCAACCCAAAGAGTGGTGACACAATCTATTCATATAAGTTTCA<br>GGGC |
| 48 | 759 | 759 | ARVTWQWLVLGGFDY |
| 48 | 760 | 760 | GCGCGAGTTACTTGGCAGTGGCTGGTCCTGGGGGGTTTTGACTAC |
| 48 | 761 | 761 | GATATTGTGCTGACTCAGTCTCCACTCTCCCTGCCCGTCACCCCTGGA<br>GAGCCGGCCTCCATCTCCTGCAGGTCTAGTCTGAGCCTCCTGCATAGT<br>AATGGAGACAACTATTTGGATTGGTACCTGCAGAAGCCAGGGCAGTC<br>TCCACAGCTCCTGATCTATTTGGGTTCTAATCGGGCCTCCGGGGTCCC<br>TGACAGGTTCAGTGGCAGTGGATCAGGCACAGATTTTACACTGAAAA<br>TCAGCCGAGTGGAGGCTGAGGATGTTGGGGTTTATTACTGCATGCAA<br>GCTCTACACACTCCCCTCACTTTCGGCGGAGGGACCAAGCTGGAGAT<br>CAAA |
| 48 | 762 | 762 | DIVLTQSPLSLPVTPGEPASISCRSSLSLLHSNGDNYLDWYLQKPGQSPQL<br>LIYLGSNRASGVPDRFSGSGSGTDFTLKISRVEAEDVGVYYCMQALHTPL<br>TFGGGTKLEIK |
| 48 | 763 | 763 | RSSLSLLHSNGDNYLD |
| 48 | 764 | 764 | AGGTCTAGTCTGAGCCTCCTGCATAGTAATGGAGACAACTATTTGGAT |
| 48 | 765 | 765 | LGSNRAS |
| 48 | 766 | 766 | TTGGGTTCTAATCGGGCCTCC |
| 48 | 767 | 767 | MQALHTPLT |

TABLE 6-continued

Informal Sequence Listing

| Antibody No. | Seq. Ref. No. | SEQ ID NO. | Sequence |
|---|---|---|---|
| 48 | 768 | 768 | ATGCAAGCTCTACACACTCCCCTCACT |
| 49 | 769 | 769 | GAGGTGCAGCTGGTGGAGTCTGGGGGAGGCTTGGTCCAGCCTGGGGG<br>GTCCCTGAAACTCTCCTGTACTTCCTCTGGGCTCGCCTTCAGTGGCTCT<br>GCTATACACTGGGTCCGCCAGGCTTCCGGGAAAGGGCTGGAGTGGGT<br>TGGCCGTATTAGAAGCAAACCTAACAGTTACGCGACAGAATATGCTG<br>CGTCGGTGAAGGGGAGGTTCACCATCTCCAGAGATGATTCACAGAAC<br>ACGGCGTATCTGCAAATGAACAGCCTGAAAGCCGAGGACACGGCCCT<br>GTATTACTGTACTTTAGGATATTGTAGTGGTGATAGCTGCTCCTCTCTT<br>AGGGACTACTGGGGCCAGGGAACCCTGGTCACCGTCTCCTCA |
| 49 | 770 | 770 | EVQLVESGGGLVQPGGSLKLSCTSSGLAFSGSAIHWVRQASGKGLEWVG<br>RIRSKPNSYATEYAASVKGRFTISRDDSQNTAYLQMNSLKAEDTALYYC<br>TLGYCSGDSCSSLRDYWGQGTLVTVSS |
| 49 | 771 | 771 | LAFSGSAIH |
| 49 | 772 | 772 | CTCGCCTTCAGTGGCTCTGCTATACAC |
| 49 | 773 | 773 | RIRSKPNSYATEYAASVKG |
| 49 | 774 | 774 | CGTATTAGAAGCAAACCTAACAGTTACGCGACAGAATATGCTGCGTC<br>GGTGAAGGGG |
| 49 | 775 | 775 | TLGYCSGDSCSSLRDY |
| 49 | 776 | 776 | ACTTTAGGATATTGTAGTGGTGATAGCTGCTCCTCTCTTAGGGACTAC |
| 49 | 777 | 777 | CAGTCTGCTCTGATTCAGCCTGCCTCCGTGTCTGGGTCTCCTGGACAG<br>TCGATCACCATCTCCTGCACTGGAACCAGCAGTGACGTTGGTGGTTAT<br>AACTATGTCTCTTGGTACCAACAGCACCCAGGCAAAGCCCCCAAACT<br>CATGATTTATGATGTCAGTAATCGGCCCTCAGGGGTTTCTAATCGCTT<br>CTCTGGCTCCAAGTCTGGCAACACGGCCTCCCTGACCATCTCTGGGCT<br>CCAGGCTGAGGACGAGGCTGATTATTACTGCAGCTCATATACAAGTA<br>GCAGCACTCTCGTGTTCGGCGGAGGGACCAAGGTCACCGTCCTA |
| 49 | 778 | 778 | QSALIQPASVSGSPGQSITISCTGTSSDVGGYNYVSWYQQHPGKAPKLMI<br>YDVSNRPSGVSNRFSGSKSGNTASLTISGLQAEDEADYYCSSYTSSSTLVF<br>GGGTKVTVL |
| 49 | 779 | 779 | TGTSSDVGGYNYVS |
| 49 | 780 | 780 | ACTGGAACCAGCAGTGACGTTGGTGGTTATAACTATGTCTCT |
| 49 | 781 | 781 | DVSNRPS |
| 49 | 782 | 782 | GATGTCAGTAATCGGCCCTCA |
| 49 | 783 | 783 | SSYTSSSTLV |
| 49 | 784 | 784 | AGCTCATATACAAGTAGCAGCACTCTCGTG |
| 50 | 785 | 785 | CAGGTCCAGCTGGTGCAGTCTGGAAGTGAGGTGAAGAAGCCTGGGGC<br>CTCGGTGAAGGTCTCCTGCAAGGCCTCAGGTTACAGGTTTTCCAACTA<br>TGGTATCAGCTGGGTGCGACAGGCCCCTGGACAAGGCCTAGAGTGGA<br>TGGGATGGATCAGCGCTTACAATGGAAACATAAAGTATGGAAATAAC<br>CTCCAGGGCAGAGTCACCGTGACCACAGACACATCCACGACCACGGC<br>CTACATGGAGGTGAGGAGCCTGACATCTGACGACACGGCCGTGTATT<br>ACTGTGCGAGAGATGTCCCAGCTGACGGGGTCCACTTCATGGACGTC<br>TGGGGCAAAGGGACCACGGTCACCGTCTCCTCA |
| 50 | 786 | 786 | QVQLVQSGSEVKKPGASVKVSCKASGYRFSNYGISWVRQAPGQGLEWM<br>GWISAYNGNIKYGNNLQGRVTVTTDTSTTTAYMEVRSLTSDDTAVYYC<br>ARDVPADGVHFMDVWGKGTTVTVSS |
| 50 | 787 | 787 | YRFSNYGIS |
| 50 | 788 | 788 | TACAGGTTTTCCAACTATGGTATCAGC |
| 50 | 789 | 789 | WISAYNGNIKYGNNLQG |
| 50 | 790 | 790 | TGGATCAGCGCTTACAATGGAAACATAAAGTATGGAAATAACCTCCA<br>GGGC |

TABLE 6-continued

Informal Sequence Listing

| Antibody No. | Seq. Ref. No. | SEQ ID NO. | Sequence |
|---|---|---|---|
| 50 | 791 | 791 | ARDVPADGVHFMDV |
| 50 | 792 | 792 | GCGAGAGATGTCCCAGCTGACGGGGTCCACTTCATGGACGTC |
| 50 | 793 | 793 | GATATTGTGATGACTCAGACTCCACTCTCCCTGCCCGTCACCCTTGGA CAGCCGGCCTCCATCTCCTGCAGGTCTAGTCAAAGCCTCGTACACAGT GATACTAACACCTACTTGAACTGGTTTCAGCAGAGGCCAGGCCAATC TCCACGGCGCCTAATTTATAAGGTTTCTAACCGGGACTCTGGGGTCCC AGACAGATTCAGCGGCAGTGGGTCAGGCACTACTTTCACACTGAAAA TCAGCAGGGTGGAGGCTGAGGATGTTGGGATTTATTACTGCATGCAG GGTTCACACTGGGCTCCGACTTTCGGCCAGGGGACCAAGGTGGAAAT CAAA |
| 50 | 794 | 794 | DIVMTQTPLSLPVTLGQPASISCRSSQSLVHSDTNTYLNWFQQRPGQSPR RLIYKVSNRDSGVPDRFSGSGSGTTFTLKISRVEAEDVGIYYCMQGSHWA PTFGQGTKVEIK |
| 50 | 795 | 795 | RSSQSLVHSDTNTYLN |
| 50 | 796 | 796 | AGGTCTAGTCAAAGCCTCGTACACAGTGATACTAACACCTACTTGAAC |
| 50 | 797 | 797 | KVSNRDS |
| 50 | 798 | 798 | AAGGTTTCTAACCGGGACTCT |
| 50 | 799 | 799 | MQGSHWAPT |
| 50 | 800 | 800 | ATGCAGGGTTCACACTGGGCTCCGACT |
| 51 | 801 | 801 | CAGGTCCAGCTGGTGCAGTCTGGGGGAGGCGTGGTCCAGCCTGGGAG GTCCCTGAGACTCTCCTGTGCAGCGTCTGGATTCACCTTCAGTAACTA TGGCATGCACTGGGTCCGCCAGGCTCCAGGCAAGGGGCTGGAGTGGG TGGCAGTTATATGGTATGATGGAAGTAATAAATACTATGCAGACTCC GTGAAGGGCCGATTCACCATCTCCAGAGACAATTCCAAGAACACGGT ATATCTGCAAATGAACAGCCTGAGAGCCGACGACACGGCTGTCTATT ACTGTGCGAGAGATGCGATATTTGGCAGTGGCCCCAACTGGTTCGAC CCCTGGGGTCAGGGAACCCTGGTCACCGTCTCCTCA |
| 51 | 802 | 802 | QVQLVQSGGGVVQPGRSLRLSCAASGFTFSNYGMHWVRQAPGKGLEW VAVIWYDGSNKYYADSVKGRFTISRDNSKNTVYLQMNSLRADDTAVYY CARDAIFGSGPNWFDPWGQGTLVTVSS |
| 51 | 803 | 803 | FTFSNYGMH |
| 51 | 804 | 804 | TTCACCTTCAGTAACTATGGCATGCAC |
| 51 | 805 | 805 | VIWYDGSNKYYADSVKG |
| 51 | 806 | 806 | GTTATATGGTATGATGGAAGTAATAAATACTATGCAGACTCCGTGAA GGGC |
| 51 | 807 | 807 | ARDAIFGSGPNWFDP |
| 51 | 808 | 808 | GCGAGAGATGCGATATTTGGCAGTGGCCCCAACTGGTTCGACCCC |
| 51 | 809 | 809 | CAGTCTGTCCTGACGCAGCCGCCCTCAGTGTCTGGGGCCCAGGGCA GAGGGTCACCATCTCCTGCACTGGGAGCAGCTCCAACATCGGGGCAG GTTATGATGTACACTGGTACCAGCAGCTTCCAGGAACAGCCCCCAAA CTCCTCATCTATGGTAGCAGCAATCGGCCCTCAGGGGTCCCTGACCGG TTCTCTGGCTCCAAGTCTGGCACCTCAGCCTCCTGGCCATCACTGGG CTCCAGGCTGAGGATGAGGCTGATTATTACTGCCAGTCCTATGAAG CAGCCTGAGAGGTTGGGTGTTCGGCGGAGGGACCAAGGTCACCGTCC TA |
| 51 | 810 | 810 | QSVLTQPPSVSGAPGQRVTISCTGSSSNIGAGYDVHWYQQLPGTAPKLLI YGSSNRPSGVPDRFSGSKSGTSASLAITGLQAEDEADYYCQSYESSLRGW VFGGGTKVTVL |
| 51 | 811 | 811 | TGSSSNIGAGYDVH |
| 51 | 812 | 812 | ACTGGGAGCAGCTCCAACATCGGGGCAGGTTATGATGTACAC |
| 51 | 813 | 813 | GSSNRPS |

TABLE 6-continued

Informal Sequence Listing

| Antibody No. | Seq. Ref. No. | SEQ ID NO. | Sequence |
|---|---|---|---|
| 51 | 814 | 814 | GGTAGCAGCAATCGGCCCTCA |
| 51 | 815 | 815 | QSYESSLRGWV |
| 51 | 816 | 816 | CAGTCCTATGAAAGCAGCCTGAGAGGTTGGGTG |
| 52 | 817 | 817 | GAGGTGCAGCTGGTGGAGTCGGGGGGAGGCGTGGTCCAGCCTGGGAGGTCCCTGAGACTCTCCTGTGCAGCCTCTGGATTCACCTTCAGTGACCATGCTATGTACTGGGTCCGCCAGGCTCCAGGCAAAGGGCTAGAGTGGGTGGCACTTATATCATTTGATGGAAGGAATATATACTACGCAGACTCCGTGAAGGGCCGATTCACCATCTCCAGAGACAATTCCAAGAACACGCTGTATCTGCAGATGAACAGCCTGAGAGCTGAGGACACGGCTGTCTATTACTGTGCGAGAGATCAATGGCTGGTTCCTGACTACTGGGGCCAGGGAACCCTGGTCACCGTCTCCTCA |
| 52 | 818 | 818 | EVQLVESGGGVVQPGRSLRLSCAASGFTFSDHAMYWVRQAPGKGLEWVALISFDGRNIYYADSVKGRFTISRDNSKNTLYLQMNSLRAEDTAVYYCARDQWLVPDYWGQGTLVTVSS |
| 52 | 819 | 819 | FTFSDHAMY |
| 52 | 820 | 820 | TTCACCTTCAGTGACCATGCTATGTAC |
| 52 | 821 | 821 | LISFDGRNIYYADSVKG |
| 52 | 822 | 822 | CTTATATCATTTGATGGAAGGAATATATACTACGCAGACTCCGTGAAGGGC |
| 52 | 823 | 823 | ARDQWLVPDY |
| 52 | 824 | 824 | GCGAGAGATCAATGGCTGGTTCCTGACTAC |
| 52 | 825 | 825 | CAGTCTGTTCTGACTCAGCCTGCCTCCGTGTCTGGGTCTCCTGGACAGTCGATCACCATCTCCTGCACTGGAACCAGCAGTGACGTTGGTGGTTATAACTATGTCTCCTGGTACCAACAGCACCCAGGCAACGCCCCCAAACTCATGATTTATGAAGTCAGTAAGCGGCCCTCAGGGGTCCCTGATCGCTTCTCTGGCTTCAAGTCTGGCAACACGGCCTCCCTGACCGTCTCTGGGCTCCAGGCTGAGGATGAGGCTGATTATTACTGCAGCTCATATGCAGGCAGCAACAGTGTCTTCGGAACTGGGACCAAGGTCACCGTCCTA |
| 52 | 826 | 826 | QSVLTQPASVSGSPGQSITISCTGTSSDVGGYNYVSWYQQHPGNAPKLMIYEVSKRPSGVPDRFSGFKSGNTASLTVSGLQAEDEADYYCSSYAGSNSVFGTGTKVTVL |
| 52 | 827 | 827 | TGTSSDVGGYNYVS |
| 52 | 828 | 828 | ACTGGAACCAGCAGTGACGTTGGTGGTTATAACTATGTCTCC |
| 52 | 829 | 829 | EVSKRPS |
| 52 | 830 | 830 | GAAGTCAGTAAGCGGCCCTCA |
| 52 | 831 | 831 | SSYAGSNSV |
| 52 | 832 | 832 | AGCTCATATGCAGGCAGCAACAGTGTC |
| 53 | 833 | 833 | GAGGTGCAGCTGGTGGAGTCTGGGGGAGGCTTGGTAAGGCGGGGGGGTCCCTTGGACTCTCATGTTCAGCCTCTGGATTCATTTTCAGTAACGCTTGGATGACCTGGGTCCGCCAGGCTCCAGGGAAGGGACTGGAGTGGGTCGGCCATATTAAAAGCAAAGTTAATGGTGGGACAACAGCCTACGGTGCACCCGTGAAAGGCAGATTCACCATCTCAAGAGATGATTCACGAACACGCTGTTTCTGCAAATGAACAGCCTGAAAACCGAGGACACAGGCGTGTATTACTGTACTACAGGCCCACCCTATCAGTACTTTGATGATTCCGGTTATTCGGTCGTGGACTACTGGGGCCAGGGAACCCTGGTCACCGTCTCCTCC |
| 53 | 834 | 834 | EVQLVESGGGLVRPGGSLGLSCSASGFIFSNAWMTWVRQAPGKGLEWVGHIKSKVNGGTTAYGAPVKGRFTISRDDSRNTLFLQMNSLKTEDTGVYYCTTGPPYQYFDDSGYSVVDYWGQGTLVTVSS |
| 53 | 835 | 835 | FIFSNAWMT |
| 53 | 836 | 836 | TTCATTTTCAGTAACGCTTGGATGACC |

TABLE 6-continued

Informal Sequence Listing

| Antibody Seq. Ref. No. | SEQ ID NO. | Sequence |
|---|---|---|
| 53 | 837 | 837 | HIKSKVNGGTTAYGAPVKG |
| 53 | 838 | 838 | CATATTAAAAGCAAAGTTAATGGTGGGACAACAGCCTACGGTGCACC CGTGAAAGGC |
| 53 | 839 | 839 | TTGPPYQYFDDSGYSVVDY |
| 53 | 840 | 840 | ACTACAGGCCCACCCTATCAGTACTTTGATGATTCCGGTTATTCGGTC GTGGACTAC |
| 53 | 841 | 841 | CAGTCTGTGGTGACGCAGCCGCCCTCAGCGTCTGGGACCCCCGGGCA GAGGGTCACCATCTCTTGTTCTGGAAGCGACTCCAACATCGGAACTG ATTATTTTTACTGGTACCAGCAGCTCCCAGGATCGGCCCCCAAACTCC TCATCTATGGTAGTAATCAGCGGCCCTCCGGGGTCCCTGACCGATTCT CTGGCTCCCAGTCTGGCTCCGCAGCCTCCTGGCCATCAGTGGCCTCC GGTCCGAGGATGACGCTGACTATTACTGTGCAGCATGGGATGACAGC CTGGGTGGTCCGGTGTTCGGCGGTGGGACCAAGGTCACCGTCCTA |
| 53 | 842 | 842 | QSVVTQPPSASGTPGQRVTISCSGSDSNIGTDYFYWYQQLPGSAPKLLIY GSNQRPSGVPDRFSGSQSGSAASLAISGLRSEDDADYYCAAWDDSLGGP VFGGGTKVTVL |
| 53 | 843 | 843 | SGSDSNIGTDYFY |
| 53 | 844 | 844 | TCTGGAAGCGACTCCAACATCGGAACTGATTATTTTTAC |
| 53 | 845 | 845 | GSNQRPS |
| 53 | 846 | 846 | GGTAGTAATCAGCGGCCCTCC |
| 53 | 847 | 847 | AAWDDSLGGPV |
| 53 | 848 | 848 | GCAGCATGGGATGACAGCCTGGGTGGTCCGGTG |
| 54 | 849 | 849 | CAGGTGCAGCTACAGCAGTGGGGCACAGGACTGGTGAAGCCTTCGGA GACCCTGTCCCTAACCTGCGCAGTCTCTGGTGGGCCTTCAGCGGTCA CCAGTGGAACTGGTTCCGCCAGCCCCCCGGGAAGGGTCTGGAGTGGA TTGGAGAAATCAATGTCAGTGGCAACACCCACTACAACGTGTCCCTC AGGAGTCGGGTCACCATTTCTCTGGACGAGTCCAAGAAACAATTCTC CCTGAAAATGACCTCTGTCACCGCCGCGGATACGGCTATTTACTACTG TGCAAAAGCCTCGAGTGGGTCTTATCACTTCGAGTATTGGTTCGACCC CTGGAGCCAGGGAACAATGGTCACCGTCTCCTCA |
| 54 | 850 | 850 | QVQLQQWGTGLVKPSETLSLTCAVSGGAFSGHQWNWFRQPPGKGLEWI GEINVSGNTHYNVSLRSRVTISLDESKKQFSLKMTSVTAADTAIYYCAKA SSGSYHFEYWFDPWSQGTMVTVSS |
| 54 | 851 | 851 | GAFSGHQWN |
| 54 | 852 | 852 | GGGGCCTTCAGCGGTCACCAGTGGAAC |
| 54 | 853 | 853 | EINVSGNTHYNVSLRS |
| 54 | 854 | 854 | GAAATCAATGTCAGTGGCAACACCCACTACAACGTGTCCCTCAGGAGT |
| 54 | 855 | 855 | AKASSGSYHFEYWFDP |
| 54 | 856 | 856 | GCGAAAGCCTCGAGTGGGTCTTATCACTTCGAGTATTGGTTCGACCCC |
| 54 | 857 | 857 | TCCTATGAGCTGACACAGCCACCCTCGGTGTCAGTGGCCCCAGGAAA GATGGCCTGGTTTACCTGTGGGGGAAGCGACATTGGAAGTAAAAGAG TCCACTGGTACCAGCAGAAGCCGGGCCAGGCCCCTGTCCTGCTCGTG TATGATGATTCCTTACGTCCCTCAGGGACCTCTGCCCGAGTCTCTGGC TCCACCTCTGGCAACACGGCCACCCTGAGTATCATCAGCGTCGAAGC CGGGGATGAGGCCGACTATTTTTGTCAGGTGTGGGATGATGCCGACG ATCATGCGGTGTTCGGCGGAGGGACCAAGCTCACCGTCCTA |
| 54 | 858 | 858 | SYELTQPPSVSVAPGKMAWFTCGGSDIGSKRVHWYQQKPGQAPVLLVY DDSLRPSGTSARVSGSTSGNTATLSIISVEAGDEADYFCQVWDDADDHA VFGGGTKLTVL |
| 54 | 859 | 859 | GGSDIGSKRVH |
| 54 | 860 | 860 | GGGGGAAGCGACATTGGAAGTAAAAGAGTCCAC |

TABLE 6-continued

Informal Sequence Listing

| Antibody No. | Seq. Ref. No. | SEQ ID NO. | Sequence |
|---|---|---|---|
| 54 | 861 | 861 | DDSLRPS |
| 54 | 862 | 862 | GATGATTCCTTACGTCCCTCA |
| 54 | 863 | 863 | QVWDDADDHAV |
| 54 | 864 | 864 | CAGGTGTGGGATGATGCCGACGATCATGCGGTG |
| 55 | 865 | 865 | GAGGTGCAGCTGGTGGAGTCGGGGGGAGGCGTGGTCCAGCCTGGGAGGTCCCTGAGACTCTCCTGTGCAGCCTCTGGATTCACCTTCAGTGACCATGCTATGTACTGGGTCCGCCAGGCTCCAGGCAAAGGGCTAGAGTGGGTGGCACTTATATCATTTGATGGAAGGAATATATACTACGCAGACTCCGTGAAGGGCCGATTCACCATCTCCAGAGACAATTCCAAGAACACGCTGTATCTGCAGATGAACAGCCTGAGAGCTGAGGACACGGCTGTCTATTACTGTGCGAGAGATCAATGGCTGGTTCCTGACTACTGGGGCCAGGGAACCCTGGTCACCGTCTCCTCA |
| 55 | 866 | 866 | EVQLVESGGGVVQPGRSLRLSCAASGFTFSDHAMYWVRQAPGKGLEWVALISFDGRNIYYADSVKGRFTISRDNSKNTLYLQMNSLRAEDTAVYYCARDQWLVPDYWGQGTLVTVSS |
| 55 | 867 | 867 | FTFSDHAMY |
| 55 | 868 | 868 | TTCACCTTCAGTGACCATGCTATGTAC |
| 55 | 869 | 869 | LISFDGRNIYYADSVKG |
| 55 | 870 | 870 | CTTATATCATTTGATGGAAGGAATATATACTACGCAGACTCCGTGAAGGGC |
| 55 | 871 | 871 | ARDQWLVPDY |
| 55 | 872 | 872 | GCGAGAGATCAATGGCTGGTTCCTGACTAC |
| 55 | 873 | 873 | CAGTCTGCTCTGACTCAGCCTGCCTCCGTGTCTGGGTCCCTGGACAGTCGATCACCATCTCCTGCACTGGAACCAGCAGTGACGTTGGTGGTTATAACTATGTCTCCTGGTACCAACAGCACCCAGGCAACGCCCCCAAACTCATGATTTATGAAGTCAGTAAGCGGCCCTCAGGGGTCCCTGATCGCTTCTCTGGCTTCAAGTCTGGCAACACGGCCTCCCTGACCGTCTCTGGGCTCCAGGCTGAGGATGAGGCTGATTATTACTGCAGCTCATATGCAGGCAGCAACAGTGTCTTCGGAACTGGGACCAAGGTGACCGTCCTA |
| 55 | 874 | 874 | QSALTQPASVSGSPGQSITISCTGTSSDVGGYNYVSWYQQHPGNAPKLMIYEVSKRPSGVPDRFSGFKSGNTASLTVSGLQAEDEADYYCSSYAGSNSVFGTGTKVTVL |
| 55 | 875 | 875 | TGTSSDVGGYNYVS |
| 55 | 876 | 876 | ACTGGAACCAGCAGTGACGTTGGTGGTTATAACTATGTCTCC |
| 55 | 877 | 877 | EVSKRPS |
| 55 | 878 | 878 | GAAGTCAGTAAGCGGCCCTCA |
| 55 | 879 | 879 | SSYAGSNSV |
| 55 | 880 | 880 | AGCTCATATGCAGGCAGCAACAGTGTC |
| 56 | 881 | 881 | CAGATCACCTTGAAGGAGTCTGGTCCTACGCTGGTGAAACCCACACAGACCCTCACGCTGACCTGCTCCTTCTCTGGGTTCTCACTCACCACTCGTGGAGTGGGTGTGGGCTGGGTCCGTCAGCCCCCAGGAAAGGCCCTGGAGTGCCTTGGATTCGTTTATTGGGACGATGATAAGCGCTACAGCCCATCTCTCTGAGGAGCAGACTCACCATCTCCGAGGACACGTCCAAAAACCAGGTGGTCCTTACAATGACCAACATGGACCCTTTGGACACAGCCACGTATTACTGTGTACACAGCGATCTCTATGATAGAGGTGGTTATTACTTATTCTACTTTGACTACTGGGGCCAGGGAACCCTGGTCACCGTCTCCTCA |
| 56 | 882 | 882 | QITLKESGPTLVKPTQTLTLTCSFSGFSLTTRGVGVGWVRQPPGKALECLGFVYWDDDKRYSPSLRSRLTISEDTSKNQVVLTMTNMDPLDTATYYCVHSDLYDRGGYYLFYFDYWGQGTLVTVSS |
| 56 | 883 | 883 | FSLTTRGVGVG |

TABLE 6-continued

Informal Sequence Listing

| Antibody No. | Seq. Ref. No. | SEQ ID NO. | Sequence |
|---|---|---|---|
| 56 | 884 | 884 | TTCTCACTCACCACTCGTGGAGTGGGTGTGGGC |
| 56 | 885 | 885 | FVYWDDDKRYSPSLRS |
| 56 | 886 | 886 | TTCGTTTATTGGGACGATGATAAGCGCTACAGCCCATCTCTGAGGAGC |
| 56 | 887 | 887 | VHSDLYDRGGYYLFYFDY |
| 56 | 888 | 888 | GTACACAGCGATCTCTATGATAGAGGTGGTTATTACTTATTCTACTTTGACTAC |
| 56 | 889 | 889 | GATATTGTGCTGACTCAGTCTCCATCCTCCCTGTCTGCATCTGTGGGGGACAGAGTCACCATCACTTGCCGGGCAAGTCAGCCCATTGCCAGCTATTTAAATTGGTATCAGCACAAACCAGGGAAAGCCCCTAAACTCCTGATCTATGCTGCATCCAGTTTGCAGAGTGGGGTCTCATCAACATTCAGTGGCCGGGGATCTGGGACAGATTTCACTCTCACCATCACCGCTCTGCAACCTGAAGATTTTGCAATTTACTACTGTCAACAGAGTTACACTTTCCCGTACACTTTTGGCCAGGGGACCAAAGTGGATATCAAA |
| 56 | 890 | 890 | DIVLTQSPSSLSASVGDRVTITCRASQPIASYLNWYQHKPGKAPKLLIYAASSLQSGVSSTFSGRGSGTDFTLTITALQPEDFAIYYCQQSYTFPYTFGQGTKVDIK |
| 56 | 891 | 891 | RASQPIASYLN |
| 56 | 892 | 892 | CGGGCAAGTCAGCCCATTGCCAGCTATTTAAAT |
| 56 | 893 | 893 | AASSLQS |
| 56 | 894 | 894 | GCTGCATCCAGTTTGCAGAGT |
| 56 | 895 | 895 | QQSYTFPYT |
| 56 | 896 | 896 | CAACAGAGTTACACTTTCCCGTACACT |
| 57 | 897 | 897 | CAGGTGCAGCTGGTGCAGTCTGGAGCAGAGGTGAAGAAGCCGGGGGAGTCTCTGAAGATCTCCTGTCAAGGTTCTGGATATAGTTTTAGAAGTTACTGGATCGGTTGGGTGCGCCAGAAGCCCGGGAAAGGCCTGGAATATATGGGCATCATCTTTCCTAATGACTTTGATACCAGATACAGCCCGTCCTTCCAAGGCCAGGTCACCATCTCCGTCGACAAGTCCACCAGCACCGCCTTCCTGCAGTGGACCAGCCTGCAGGCCTCGGACACCGCCATATATTATTGTGGCAGACAAGAGCTGCAGGGTAGTTTTACTATATGGGGCCAAGGGACAATGGTCACCGTCACTTCA |
| 57 | 898 | 898 | QVQLVQSGAEVKKPGESLKISCQGSGYSFRSYWIGWVRQKPGKGLEYMGIIFPNDFDTRYSPSFQGQVTISVDKSTSTAFLQWTSLQASDTAIYYCGRQELQGSFTIWGQGTMVTVS |
| 57 | 899 | 899 | YSFRSYWIG |
| 57 | 900 | 900 | TATAGTTTTAGAAGTTACTGGATCGGT |
| 57 | 901 | 901 | IIFPNDFDTRYSPSFQG |
| 57 | 902 | 902 | ATCATCTTTCCTAATGACTTTGATACCAGATACAGCCCGTCCTTCCAAGGC |
| 57 | 903 | 903 | GRQELQGSFTI |
| 57 | 904 | 904 | GGCAGACAAGAGCTGCAGGGTAGTTTTACTATA |
| 57 | 905 | 905 | GATATTGTGATGACTCAGTCTCCATCCTCCCTGTCCGCATCTGTCGGAGACAGAGTCACCATCACTTGCCAGGCGAGTCAGGACATGGGCAATTCTTTAAATTGGTATCAGCAAAAGTCAGGGAAAGCCCCTAAACTCCTGATCTACGATGCATCGTATTTGGATTCAGGGGTCCCATCAAGGTTCAGTGGCAGTGGATCTGGGACACATTTTACTTTCACCATCAGCACCCTGCAGCCTGAAGATATTGCAACATATTACTGTCAACATTATGATAATCTCCTCTTATTCACTTTCGGCCCTGGGACCAAGCTGGAGATCAAA |
| 57 | 906 | 906 | DIVMTQSPSSLSASVGDRVTITCQASQDMGNSLNWYQQKSGKAPKLLIYDASYLDSGVPSRFSGSGSGTHFTFTISTLQPEDIATYYCQHYDNLLLFTFGPGTKLEIK |
| 57 | 907 | 907 | QASQDMGNSLN |

TABLE 6-continued

Informal Sequence Listing

| Antibody No. | Seq. Ref. No. | SEQ ID NO. | Sequence |
|---|---|---|---|
| 57 | 908 | 908 | CAGGCGAGTCAGGACATGGGCAATTCTTTAAAT |
| 57 | 909 | 909 | DASYLDS |
| 57 | 910 | 910 | GATGCATCGTATTTGGATTCA |
| 57 | 911 | 911 | QHYDNLLLFT |
| 57 | 912 | 912 | CAACATTATGATAATCTCCTCTTATTCACT |
| 58 | 913 | 913 | CAGATCACCTTGAAGGAGTCTGGTCCTACCCTGGTGAAACCCACACA<br>GACCCTCACGCTGACCTGCACCTTCTCTGGGTTCTCACTCACCACTCG<br>TGGAGTGGGTGTGGGCTGGATCCGTCAGCCCCCAGGAAAGGCCCTGG<br>AGTTCCTAGGATTCATTCATTGGGATGATGATAAGACCTACAGCCCAT<br>CTCTGAGGAGGAGACTCACCATCACCAAGGACACCTCCAACAACGAG<br>GTGGTCCTTACAATGACCAACATGGACCCTGTGGACACAGCCACATA<br>TTACTGTGTCCACAGCGATCTCTATGATAGTGGTGGTTATTACTTATA<br>CTACTTTGACTACTGGGGCCAGGGAACCCTGGTCACCGTCTCCTCA |
| 58 | 914 | 914 | QITLKESGPTLVKPTQTLTLTCTFSGFSLTTRGVGVGWIRQPPGKALEFLG<br>FIHWDDDKTYSPSLRRRLTITKDTSNNEVVLTMTNMDPVDTATYYCVHS<br>DLYDSGGYYLYYFDYWGQGTLVTVSS |
| 58 | 915 | 915 | FSLTTRGVGVG |
| 58 | 916 | 916 | TTCTCACTCACCACTCGTGGAGTGGGTGTGGGC |
| 58 | 917 | 917 | FIHWDDDKTYSPSLRR |
| 58 | 918 | 918 | TTCATTCATTGGGATGATGATAAGACCTACAGCCCATCTCTGAGGAGG |
| 58 | 919 | 919 | VHSDLYDSGGYYLYYFDY |
| 58 | 920 | 920 | GTCCACAGCGATCTCTATGATAGTGGTGGTTATTACTTATACTACTTT<br>GACTAC |
| 58 | 921 | 921 | GAAATTGTGATGACACAGTCTCCATCCTCCCTGTCTGCATCTGTGGGG<br>GACAGAGTCACCATCACTTGCCGGGCAAGTCAGCCCATTCCCAGTTA<br>TGTAAATTGGTATCAGCAGAGACCAGGGAAAGCCCCTAAGCTCCTGA<br>TCTATGCTGCATCCAATTTGCAGAGTGGGGTCTCATCAAAATTTAGTG<br>GCAGGGGATTTGGGACAGATTTCACTCTCACCATCGACACTCTGCAA<br>CCTGAAGATTTTGCAACTTACTACTGTCAACAGGTTTACACTTCCCCG<br>TACACTTTTGGCCAGGGGACCAAGCTGGAGATCAAA |
| 58 | 922 | 922 | EIVMTQSPSSLSASVGDRVTITCRASQPIPSYVNWYQQRPGKAPKLLIYA<br>ASNLQSGVSSKFSGRGFGTDFTLTIDTLQPEDFATYYCQQVYTSPYTFGQ<br>GTKLEIK |
| 58 | 923 | 923 | RASQPIPSYVN |
| 58 | 924 | 924 | CGGGCAAGTCAGCCCATTCCCAGTTATGTAAAT |
| 58 | 925 | 925 | AASNLQS |
| 58 | 926 | 926 | GCTGCATCCAATTTGCAGAGT |
| 58 | 927 | 927 | QQVYTSPYT |
| 58 | 928 | 928 | CAACAGGTTTACACTTCCCCGTACACT |
| 59 | 929 | 929 | GAGGTGCAGCTGGTGGAGTCTGGTCCTACGCTGGTGAAGCCCACACA<br>GACCCTCACGCTGACCTGCACCTTCTCTGGGTTCTCACTCACCACTCG<br>TGGAATGGGTGTGGGCTGGATCCGTCAGCCCCCAGGCAGGTCCCTGG<br>AATGGCTTGCAGTCATTTATTGGGATGGTGATGTGCGCTACAGTCCAT<br>CTCTGAAGGGCAGGCTCACCATCACCAAAGACACCCCCAAAAACCAG<br>GTGGTCCTTACAATGACCAACATGGACCCTGTGGACACAGCCACATA<br>TTACTGTGTACACAGCGATCTCTATGATAGGAATGCTTATTACCTGCA<br>CTACTTTGACTTCTGGGGCCAAGGAACCCTGGTCACCGTCTCCTCA |
| 59 | 930 | 930 | EVQLVESGPTLVKPTQTLTLTCTFSGFSLTTRGMGVGWIRQPPGRSLEWL<br>AVIYWDGDVRYSPSLKGRLTITKDTPKNQVVLTMTNMDPVDTATYYCV<br>HSDLYDRNAYYLHYFDFWGQGTLVTVSS |

TABLE 6-continued

Informal Sequence Listing

| Antibody No. | Seq. Ref. No. | SEQ ID NO. | Sequence |
|---|---|---|---|
| 59 | 931 | 931 | FSLTTRGMGVG |
| 59 | 932 | 932 | TTCTCACTCACCACTCGTGGAATGGGTGTGGGC |
| 59 | 933 | 933 | VIYWDGDVRYSPSLKG |
| 59 | 934 | 934 | GTCATTTATTGGGATGGTGATGTGCGCTACAGTCCATCTCTGAAGGGC |
| 59 | 935 | 935 | VHSDLYDRNAYYLHYFDF |
| 59 | 936 | 936 | GTACACAGCGATCTCTATGATAGGAATGCTTATTACCTGCACTACTTTGACTTC |
| 59 | 937 | 937 | GACATCCGGTTGACCCAGTCTCCATCCTCCCTGTCTGCATCTGTAGGAGACAGAGTCACCATCACTTGCCGGGCAAGTCAGATTATTGCCAGTTATTTAAATTGGTATCAGCAGAAACCAGGGAAAGCCCCTAACCTCCTGATCTTTGCTGCATCCAGTTTGCAAAGTGGGGTCCCATCAAGGTTCCGTGGCAGTGGATCTGGGACAGATTTCACTCTCACCATAAGCAGTCTGCAACCTGAAGACTTTGCAACTTACTACTGTCAACAGAGTTACAGTATACCGTACACTTTTGGCCAGGGGACCAAGCTGGAGATCAAA |
| 59 | 938 | 938 | DIRLTQSPSSLSASVGDRVTITCRASQIIASYLNWYQQKPGKAPNLLIFAASSLQSGVPSRFRGSGSGTDFTLTISSLQPEDFATYYCQQSYSIPYTFGQGTKLEIK |
| 59 | 939 | 939 | RASQIIASYLN |
| 59 | 940 | 940 | CGGGCAAGTCAGATTATTGCCAGTTATTTAAAT |
| 59 | 941 | 941 | AASSLQS |
| 59 | 942 | 942 | GCTGCATCCAGTTTGCAAAGT |
| 59 | 943 | 943 | QQSYSIPYT |
| 59 | 944 | 944 | CAACAGAGTTACAGTATACCGTACACT |
| 60 | 945 | 945 | CAGGTCCAGCTGGTGCAGTCTGGTCCTGCACTGGTGAAACCCACACAGACCCTCACGCTGACCTGCACCTTCTCTGGATTCTCACTCACCACTCGTGGAGTGGGTGTGGGCTGGATCCGTCAGACCCCAGGGAAAGGCCCTGGAGTGCCTTGGATTCATTTATTGGGATGATGATATGAACTACAACCCATCTCTGAGGGGCAGAGTCACCATCACCAGGGACACCTCCAAAAACCAGGTGGTCCTAACAATGACCAACATGGCCCCTGTGGACACAGGCACATATTACTGTGTACACAGCGATCTCTATGATAGTAGCGGTTATTATTTATATTACTTTGACTACTGGGGCCAGGGAACCCTGGTCACCGTCTCCTCA |
| 60 | 946 | 946 | QVQLVQSGPALVKPTQTLTLTCTFSGFSLTTRGVGVGWIRQTPGKALECLGFIYWDDDMNYNPSLRGRVTITRDTSKNQVVLTMTNMAPVDTGTYYCVHSDLYDSSGYYLYYFDYWGQGTLVTVSS |
| 60 | 947 | 947 | FSLTTRGVGVG |
| 60 | 948 | 948 | TTCTCACTCACCACTCGTGGAGTGGGTGTGGGC |
| 60 | 949 | 949 | FIYWDDDMNYNPSLRG |
| 60 | 950 | 950 | TTCATTTATTGGGATGATGATATGAACTACAACCCATCTCTGAGGGGC |
| 60 | 951 | 951 | VHSDLYDSSGYYLYYFDY |
| 60 | 952 | 952 | GTACACAGCGATCTCTATGATAGTAGCGGTTATTATTTATATTACTTTGACTAC |
| 60 | 953 | 953 | GACATCCGGTTGACCCAGTCTCCATCCTCCCTGTCTGCATCTGTGGGGGACAGAGTCACCATCACTTGCCGGGCAAGTCAGCCCATTGCCAGTTATTTAAATTGGTATCAGCAGAAACCAGGGAAAGCCCCTAAACTCCTGATCTATGCTGCATCCAATTTGCAGAGTGGGGTCCCTTCAACATTCAGTGGCAGGGGATCTGGGACAGATTTCTCTCTCACCATCTCCACTCTGCAACCTGAAGACATTGCAACTTACTACTGTCAACAGAGTTACACCTCCCCCTACACTTTTGGCCAGGGGACCAAGGTGGAGATCAAA |
| 60 | 954 | 954 | DIRLTQSPSSLSASVGDRVTITCRASQPIASYLNWYQQKPGKAPKLLIYAASNLQSGVPSTFSGRGSGTDFSLTISTLQPEDIATYYCQQSYTSPYTFGQGTKVEIK |

TABLE 6-continued

Informal Sequence Listing

| Antibody Ref. No. | Seq. Ref. No. | SEQ ID NO. | Sequence |
|---|---|---|---|
| 60 | 955 | 955 | RASQPIASYLN |
| 60 | 956 | 956 | CGGGCAAGTCAGCCCATTGCCAGTTATTTAAAT |
| 60 | 957 | 957 | AASNLQS |
| 60 | 958 | 958 | GCTGCATCCAATTTGCAGAGT |
| 60 | 959 | 959 | QQSYTSPYT |
| 60 | 960 | 960 | CAACAGAGTTACACCTCCCCCTACACT |
| 61 | 961 | 961 | GAGGTGCAGCTGTTGGAGTCTGGGGGAGGCCTGGTTAAGCCGGGGGG GTCCCCTTAGACTCTCATGTGCAGCCTCTGGATTCATTTTCAATAACGC CTGGATGACCTGGGTCCGCCAGGCTCCAGGGAGGGGGCTGGAGTGGG TTGGCCGTATAAAAACCAATGCTGATGGTGGGACTGCAGACTACAGT ACACCCGTGAAAGGCAGATTCGCCATCTCAAGAGATGATTCTACAAA CACGCTGTATCTGCAAATGAACAGCCTGAAAACCGAGGACACAGCCG TCTATTACTGTACCACAGGCCCACCCTATAAGTACTCTGACAGTACTG GTTATTCGGTCGTTGACTACTGGGGCCAGGGCACCCTGGTCACTGTCT CTTCA |
| 61 | 962 | 962 | EVQLLESGGGLVKPGGSLRLSCAASGFIFNNAWMTWVRQAPGRGLEWV GRIKTNADGGTADYSTPVKGRFAISRDDSTNTLYLQMNSLKTEDTAVYY CTTGPPYKYSDSTGYSVVDYWGQGTLVTVSS |
| 61 | 963 | 963 | FIFNNAWMT |
| 61 | 964 | 964 | TTCATTTTCAATAACGCCTGGATGACC |
| 61 | 965 | 965 | RIKTNADGGTADYSTPVKG |
| 61 | 966 | 966 | CGTATAAAAACCAATGCTGATGGTGGGACTGCAGACTACAGTACACC CGTGAAAGGC |
| 61 | 967 | 967 | TTGPPYKYSDSTGYSVVDY |
| 61 | 968 | 968 | ACCACAGGCCCACCCTATAAGTACTCTGACAGTACTGGTTATTCGGTC GTTGACTAC |
| 61 | 969 | 969 | TCCTATGAGCTGACGCAGCCACCCTCAGCGTCTGGGACCCCCGGGCA GAGGGTCACCATCTCTTGTTCTGGAAGCAGCTCCAACATCGGAAGTA ATTATGTATATTGGTACCAGCAGCTCCCAGGAACGGCCCCCAAACTC CTCATCTATAGTACTAATCAGCGGCCCTCAGGGGTCCCTGACCGATTC TCTGGCTCCCAGTCTGGCACCTCAGCCTCCTGGCCATCAGTGGGCTC CGGTCCGAGGATGAGGCTGATTATTACTGTGCAGCGTGGGATGACCG CCTGAGTGGTCCGGTGTTCGGCGGGGCACCCAGCTGACCGTCCTC |
| 61 | 970 | 970 | SYELTQPPSASGTPGQRVTISCSGSSSNIGSNYVYWYQQLPGTAPKLLIYS TNQRPSGVPDRFSGSQSGTSASLAISGLRSEDEADYYCAAWDDRLSGPVF GGGTQLTVL |
| 61 | 971 | 971 | SGSSSNIGSNYVY |
| 61 | 972 | 972 | TCTGGAAGCAGCTCCAACATCGGAAGTAATTATGTATAT |
| 61 | 973 | 973 | STNQRPS |
| 61 | 974 | 974 | AGTACTAATCAGCGGCCCTCA |
| 61 | 975 | 975 | AAWDDRLSGPV |
| 61 | 976 | 976 | GCAGCGTGGGATGACCGCCTGAGTGGTCCGGTG |
| 62 | 977 | 977 | CAGGTCCAGCTTGTGCAGTCTGGGGCTGAGGTGAAGAAGCCGGGGTC CTCGGTGAAAATCTCCTGTAAGGCTTCTGGAGGCACCTTCAAAAGTC AAGCTATTCACTGGGTGCGACAGGCCCCTGGACAAGGGCTTGAGTGG ATGGGAAACATCATCCCTACCTACGGATCACCAAACTTCGCGCAGAG GTTCCTCGGCAGGGTCACCTTCATTGCGGACGATTCCACTGGCGCTGC CTCCATGGACCTGTATAGGCTGACATCTGAGGACACGGCCGTCTATTA CTGTGCGACAGCCGGGTGGTTCGGAGAATTAGTGCGGTTTGACTCCT GGGGCCAGGGAACCCTGGTCACCGTCTCCTCA |

TABLE 6-continued

Informal Sequence Listing

| Antibody No. | Seq. Ref. No. | SEQ ID NO. | Sequence |
|---|---|---|---|
| 62 | 978 | 978 | QVQLVQSGAEVKKPGSSVKISCKASGGTFKSQAIHWVRQAPGQGLEWM GNIIPTYGSPNFAQRFLGRVTFIADDSTGAASMDLYRLTSEDTAVYYCAT AGWFGELVRFDSWGQGTLVTVSS |
| 62 | 979 | 979 | GTFKSQAIH |
| 62 | 980 | 980 | GGCACCTTCAAAAGTCAAGCTATTCAC |
| 62 | 981 | 981 | NIIPTYGSPNFAQRFLG |
| 62 | 982 | 982 | AACATCATCCCTACCTACGGATCACCAAACTTCGCGCAGAGGTTCCTC GGC |
| 62 | 983 | 983 | ATAGWFGELVRFDS |
| 62 | 984 | 984 | GCGACAGCCGGGTGGTTCGGAGAATTAGTGCGGTTTGACTCC |
| 62 | 985 | 985 | GATATTGTGATGACTCAGTCTCCAGCCACCCTGTCTGTGTCTCCAGGG GAAAGAGCCACCCTCTCCTGCAGGGCCACTGAGAGTATTAGCAGCAA CTTAGCCTGGTACCAGCAGAAACCTGGCCAGGCTCCCAGGCTCCTCA TCTATGGTGCATCCACCAGGGCCACTGGTATCCCAGCCAGGTTCAGTG GCAGTGGGTCAGGGACAGAGTTCACTCTCACCATCAACAGCCTGCAG TCTGAAGATTTTGCAGTTTATTACTGTCAGCAGTATAATAACTGGCCT CCTCTCACTTTCGGCGGAGGGACCAAAGTGGATATCAAA |
| 62 | 986 | 986 | DIVMTQSPATLSVSPGERATLSCRATESISSNLAWYQQKPGQAPRLLIYG ASTRATGIPARFSGSGSGTEFTLTINSLQSEDFAVYYCQQYNNWPPLTFG GGTKVDIK |
| 62 | 987 | 987 | RATESISSNLA |
| 62 | 988 | 988 | AGGGCCACTGAGAGTATTAGCAGCAACTTAGCC |
| 62 | 989 | 989 | GASTRAT |
| 62 | 990 | 990 | GGTGCATCCACCAGGGCCACT |
| 62 | 991 | 991 | QQYNNWPPLT |
| 62 | 992 | 992 | CAGCAGTATAATAACTGGCCTCCTCTCACT |
| 63 | 993 | 993 | CAGGTCCAGCTGGTGCAGTCTGGGGCTGAGGTGAAGAAGCCTGGGTC CTCGGTGAAGGTCTCCTGCAAGGCTTCAGGAGACACCTTCAGCATGT ATGCTATCAGCTGGGTGCGACAGGCCCCTGGACAAGGACTTGAGTGG ATGGGAGGGGTCCTCCCAATGTTAGGGACCTCAAACTACGCACAACA GTTCCGGGGCAGAGTCACGATAACGGCGGACGGATCCACGAGCACA GCCTACATGGAGATGAGCAACCTGAGATTTGAGGACACGGCCGTTTA TTACTGTGCGAGGGTGGCCGGTCTGGGGAACAGCTATGGTCGCTACT TTGACGTCTGGGGTCAGGGAACCCTGGTCACCGTCTCCTCA |
| 63 | 994 | 994 | QVQLVQSGAEVKKPGSSVKVSCKASGDTFSMYAISWVRQAPGQGLEW MGGVLPMLGTSNYAQQFRGRVTITADGSTSTAYMEMSNLRFEDTAVYY CARVAGLGNSYGRYFDVWGQGTLVTVSS |
| 63 | 995 | 995 | DTFSMYAIS |
| 63 | 996 | 996 | GACACCTTCAGCATGTATGCTATCAGC |
| 63 | 997 | 997 | GVLPMLGTSNYAQQFRG |
| 63 | 998 | 998 | GGGGTCCTCCCAATGTTAGGGACCTCAAACTACGCACAACAGTTCCG GGGC |
| 63 | 999 | 999 | ARVAGLGNSYGRYFDV |
| 63 | 1000 | 1000 | GCGAGGGTGGCCGGTCTGGGGAACAGCTATGGTCGCTACTTTGACGTC |
| 63 | 1001 | 1001 | GACATCCGGATGACCCAGTCTCCATCTTCTGTGTCTGCATCTATTGGG GACAGAGTCACCATCACTTGTCGGGCGAGTCAGGATATCAGCACCTC GTTAGCCTGGTATCAGCAAAGACCAGGGAAAGCCCCTAATCTCCTGA TCTATGCTGCGTCCACTTTACACAGTGGGGTCCCATCGAGGTTCAGGG GCAGTGAATCTGGCCCAGACTTCACTCTCACTATCAGCAGCCTGCAGC CTGAAGATGTCGGAACTTACTATTGTCAACAGGCAAAGAGTTTCCCG TACACTTTTGGCCAGGGGACCAAGCTGGAGATCAAA |

TABLE 6-continued

Informal Sequence Listing

| Antibody No. | Seq. Ref. No. | SEQ ID NO. | Sequence |
|---|---|---|---|
| 63 | 1002 | 1002 | DIRMTQSPSSVSASIGDRVTITCRASQDISTSLAWYQQRPGKAPNLLIYAASTLHSGVPSRFRGSESGPDFTLTISSLQPEDVGTYYCQQAKSFPYTFGQGTKLEIK |
| 63 | 1003 | 1003 | RASQDISTSLA |
| 63 | 1004 | 1004 | CGGGCGAGTCAGGATATCAGCACCTCGTTAGCC |
| 63 | 1005 | 1005 | AASTLHS |
| 63 | 1006 | 1006 | GCTGCGTCCACTTTACACAGT |
| 63 | 1007 | 1007 | QQAKSFPYT |
| 63 | 1008 | 1008 | CAACAGGCAAAGAGTTTCCCGTACACT |
| 64 | 1009 | 1009 | CAGGTCCAGCTTGTGCAGTCTGGGGGAGGCCTGGTCAAGCCTGGGGGGTCCCTGAGACTCTCCTGTGCAGCTTCTGGATTCAGCCTCACAAACTACAGAATGAACTGGGTCCGCCAGGCTCCAGGGAAGGGGCTGGAGTGGGTCTCATCCCTTAAGGATTCTAGTTCTTACATCTACTACGCAGACTCAGTGAAGGGCCGATTCACCGTCTCCAGAGACGACGCGAAGAATTCATTCTTTTTGCAAATGACCAATGTAAGAGCCGAGGACACGGCTGTTTATTACTGTGCGAGAGAGGGATCGGACACGGAGTATTGGAGGCTGACGCCCCCCATGGACGTCTGGGGCAACGGGACCACGGTCACCGTCTCCTCA |
| 64 | 1010 | 1010 | QVQLVQSGGGLVKPGGSLRLSCAASGFSLTNYRMNWVRQAPGKGLEWVSSLKDSSSYIYYADSVKGRFTVSRDDAKNSFFLQMTNVRAEDTAVYYCAREGSDTEYWRLTPPMDVWGNGTTVTVSS |
| 64 | 1011 | 1011 | FSLTNYRMN |
| 64 | 1012 | 1012 | TTCAGCCTCACAAACTACAGAATGAAC |
| 64 | 1013 | 1013 | SLKDSSSYIYYADSVKG |
| 64 | 1014 | 1014 | TCCCTTAAGGATTCTAGTTCTTACATCTACTACGCAGACTCAGTGAAGGGC |
| 64 | 1015 | 1015 | AREGSDTEYWRLTPPMDV |
| 64 | 1016 | 1016 | GCGAGAGAGGGATCGGACACGGAGTATTGGAGGCTGACGCCCCCCATGGACGTC |
| 64 | 1017 | 1017 | CAGTCTGTGTTGACGCAGCCGCCCTCGGTGTCAGTGGCCCCACGACAGACGGCCAGGATTACCTGTGGGGAGCACAACATTGGAACTAAAAGTGTGCACTGGTACCAGCAGAAGCCAGGCCAGGCCCCTGTCCTGGTCATCTATGATGACAGCGACCGGCCCTCAGGGATCCCTGCGCGATTCTCTGGCTCCAACTCTGGGAACACGGCCACCCTGACCATCAGCTGGGTCGAAGCCGGGGATGAGGCCGTCTATTACTGTCAGGTGTGGGACTCAGGTGATCATCCTTGGCTGTTCGGCGGAGGCACCCAGCTGACCGTCCTC |
| 64 | 1018 | 1018 | QSVLTQPPSVSVAPRQTARITCGEHNIGTKSVHWYQQKPGQAPVLVIYDDSDRPSGIPARFSGSNSGNTATLTISWVEAGDEAVYYCQVWDSGDHPWLFGGGTQLTVL |
| 64 | 1019 | 1019 | GEHNIGTKSVH |
| 64 | 1020 | 1020 | GGGGAGCACAACATTGGAACTAAAAGTGTGCAC |
| 64 | 1021 | 1021 | DDSDRPS |
| 64 | 1022 | 1022 | GATGACAGCGACCGGCCCTCA |
| 64 | 1023 | 1023 | QVWDSGDHPWL |
| 64 | 1024 | 1024 | CAGGTGTGGGACTCAGGTGATCATCCTTGGCTG |
| 65 | 1025 | 1025 | GAGGTGCAGCTGGTGGAGTCAGGGGGAGGCTTGGTACAGCCGGGGGGGTCCCTGAGACTCTCCTGTGCAGCCTCTGGATTCCCCTTCAGTCGTTATAACATGAACTGGGTCCGCCAGGCTCCAGGGAAGGGGCTGGAGTGGGTTTCATACATTAGTAGTGGTAGTCGAAGCATTTACTACGCAGACTCTGTGAAGGGCCGATTCACCATCTCCAGAGACAATGCCAAGAACTCACTGTATCTGCAAATGAACAGCCTGAGAGCCGAGGACACGGCTGTATATT |

TABLE 6-continued

Informal Sequence Listing

| Antibody No. | Seq. Ref. No. | SEQ ID NO. | Sequence |
|---|---|---|---|
| | | | ACTGTGCGAGAGACTTAAGCGGATCTCCAGCATATAGCGGCAGCTGG GTCTGGGGCCAGGGAACCCTGGTCACCGTCTCCTCA |
| 65 | 1026 | 1026 | EVQLVESGGGLVQPGGSLRLSCAASGFPFSRYNMNWVRQAPGKGLEWV SYISSGSRSIYYADSVKGRFTISRDNAKNSLYLQMNSLRAEDTAVYYCAR DLSGSPAYSGSWVWGQGTLVTVSS |
| 65 | 1027 | 1027 | FPFSRYNMN |
| 65 | 1028 | 1028 | TTCCCCTTCAGTCGTTATAACATGAAC |
| 65 | 1029 | 1029 | YISSGSRSIYYADSVKG |
| 65 | 1030 | 1030 | TACATTAGTAGTGGTAGTCGAAGCATTTACTACGCAGACTCTGTGAA GGGC |
| 65 | 1031 | 1031 | ARDLSGSPAYSGSWV |
| 65 | 1032 | 1032 | GCGAGAGACTTAAGCGGATCTCCAGCATATAGCGGCAGCTGGGTC |
| 65 | 1033 | 1033 | GAAACGACACTCACGCAGTCTCCAGCCACCCTGTCTGTGTCTCCAGG GGAAAGAGCCACCCTCTCCTGCAGGGCCAGTCAGAGTGTTAGCAGCA ACTTAGCCTGGTACCAGCAGAAACCTGGCCAGGCTCCCAGGCTCCTC ATCTATGATGCATCCACCAGGGCCACTGGTATCCCAGACAGGTTCAG TGGCAGTGGGTCTGGGACAGAGTTCACTCTCACCATCAGCAGCCTGC AGTCTGAAGACTTTGCACTTTATTACTGTCAGCAGTATGATAGGTGGC CTCCGTGGACGTTCGGCCAAGGGACCAAGGTGGAAATCAAA |
| 65 | 1034 | 1034 | ETTLTQSPATLSVSPGERATLSCRASQSVSSNLAWYQQKPGQAPRLLIYD ASTRATGIPDRFSGSGSGTEFTLTISSLQSEDFALYYCQQYDRWPPWTFG QGTKVEIK |
| 65 | 1035 | 1035 | RASQSVSSNLA |
| 65 | 1036 | 1036 | AGGGCCAGTCAGAGTGTTAGCAGCAACTTAGCC |
| 65 | 1037 | 1037 | DASTRAT |
| 65 | 1038 | 1038 | GATGCATCCACCAGGGCCACT |
| 65 | 1039 | 1039 | QQYDRWPPWT |
| 65 | 1040 | 1040 | CAGCAGTATGATAGGTGGCCTCCGTGGACG |
| 66 | 1041 | 1041 | CAGGTCCAGCTGGTGCAGTCTGGGGCTGAGGTGAAGAAGCCTGGGGC CTCAGTGAAGGTCTCCTGCAAGGCTTCTGGAAACTCCTTCAACGACTT TTATATGCACTGGGTGCGACAGGCCCCTGGACAAGGGCTTGAGTGGA TGGGATGGATCGACCCTAACAACGGAGGCGCAAACTATGCACAGAA GTTTCATGGCAGGGTCACTATGACCAGGGACTCGTCCATCAACACAG CCTACATGGAGTTGAGCAGGCTGAGATCCGACGACACGGCCGTCTAT TACTGTGCGAGCGAGCCCCCCGGCGTTGGTTTTGGATTGATTCCCCAC TACTACTTTGACAACTGGGGCCAGGGAACCCTGGTCACCGTCTCCTCA |
| 66 | 1042 | 1042 | QVQLVQSGAEVKKPGASVKVSCKASGNSFNDFYMHWVRQAPGQGLEW MGWIDPNNGGANYAQKFHGRVTMTRDSSINTAYMELSRLRSDDTAVYY CASEPPGVGFGLIPHYYFDNWGQGTLVTVSS |
| 66 | 1043 | 1043 | NSFNDFYMH |
| 66 | 1044 | 1044 | AACTCCTTCAACGACTTTTATATGCAC |
| 66 | 1045 | 1045 | WIDPNNGGANYAQKFHG |
| 66 | 1046 | 1046 | TGGATCGACCCTAACAACGGAGGCGCAAACTATGCACAGAAGTTTCA TGGC |
| 66 | 1047 | 1047 | ASEPPGVGFGLIPHYYFDN |
| 66 | 1048 | 1048 | GCGAGCGAGCCCCCCGGCGTTGGTTTTGGATTGATTCCCCACTACTAC TTTGACAAC |
| 66 | 1049 | 1049 | GAAATTGTGATGACACAGTCTCCAGACTCCCTGGCTGTGTCTCTGGGC GAGAGGGCCACCATCAACTGCAAGTCCAGCCAGAATGTTTTAGACAC CTCCAACAATAAGAACTACTTAGCTTGGTACCAGCAGAAACCAGGAC |

TABLE 6-continued

Informal Sequence Listing

| Antibody No. | Seq. Ref. No. | SEQ ID NO. | Sequence |
|---|---|---|---|
| | | | AGCCTCCTAGACTGCTCATTTACTGGGCATCTGCCCGCGGATCCGGGG TCCCTGACCGATTCAGTGGCAGCGGGTCTGGGACACATTTCACTCTCA CCATCAGCAGCCTGCAGGCTGAAGATGTGGCAGTTTATTACTGTCAG CAATATTTTAGTATTCCTCCGACGTTCGGCCAAGGGACCAAGGTGGA GATCAAA |
| 66 | 1050 | 1050 | EIVMTQSPDSLAVSLGERATINCKSSQNVLDTSNNKNYLAWYQQKPGQP PRLLIYWASARGSGVPDRFSGSGSGTHFTLTISSLQAEDVAVYYCQQYFSI PPTFGQGTKVEIK |
| 66 | 1051 | 1051 | KSSQNVLDTSNNKNYLA |
| 66 | 1052 | 1052 | AAGTCCAGCCAGAATGTTTTAGACACCTCCAACAATAAGAACTACTT AGCT |
| 66 | 1053 | 1053 | WASARGS |
| 66 | 1054 | 1054 | TGGGCATCTGCCCGCGGATCC |
| 66 | 1055 | 1055 | QQYFSIPPT |
| 66 | 1056 | 1056 | CAGCAATATTTTAGTATTCCTCCGACG |
| 67 | 1057 | 1057 | CAGGTCCAGCTGGTGCAGTCTGGGGCTGAGGTGAAGAAGCCTGGGTC CTCGGTGAAGGTCTCCTGCAAGGTTGCCGGAGGCTCCTTCTCCAATTA TGCAATCGCCTGGCTGCGACAGGCCCCTGGACAAGGGCTTGAGTGGA TGGGAGGTATCATCCCTGCCTTTAACAGAGCAATGTATGCACGGAAG TTCCAAGACAGAGTCACAATTACCGCGTACGCATCAACGACCACTGC CTACCTGGACATTACCGGCCTCAGATCTGAGGACACGGCCCTTTATTA TTGTGCGAGGCCTGCTGGAGACTTTGGGGATTTAAAGTGGGTACGAT CGCCTTTTGACTACTGGGGCCAGGGAACCCTGATCACCGTCTCCTCA |
| 67 | 1058 | 1058 | QVQLVQSGAEVKKPGSSVKVSCKVAGGSFSNYAIAWLRQAPGQGLEW MGGIIPAFNRAMYARKFQDRVTITAYASTTTAYLDITGLRSEDTALYYCA RPAGDFGDLKWVRSPFDYWGQGTLITVSS |
| 67 | 1059 | 1059 | GSFSNYAIA |
| 67 | 1060 | 1060 | GGCTCCTTCTCCAATTATGCAATCGCC |
| 67 | 1061 | 1061 | GIIPAFNRAMYARKFQD |
| 67 | 1062 | 1062 | GGTATCATCCCTGCCTTTAACAGAGCAATGTATGCACGGAAGTTCCA AGAC |
| 67 | 1063 | 1063 | ARPAGDFGDLKWVRSPFDY |
| 67 | 1064 | 1064 | GCGAGGCCTGCTGGAGACTTTGGGGATTTAAAGTGGGTACGATCGCC TTTTGACTAC |
| 67 | 1065 | 1065 | GATATTGTGATGACGCAGACTCCAGGCACCCTGTCTGTGTCTCCAGGG GAAAGAGCCACCCTCTCCTGCAGGGCCAGTCAGGACGTTGGCATCAA CTTAGCCTGGTATCAGCAGAAGCCTGGCCAGGCTCCCAGGCTCCTCAT ATATGGTGCATCCACCAGGGCCACTGATGTCCCAGCCAAGTTCAGTG GCAGTGGGTCTGGGACAGACTTCACTCTCACCATCAGCAGCCTGCAG TCTGAAGATTTTGGAGTTTATTATTGTCAGGAGTATAATGACTGGCCT CCCCAGCTCTCTTTCGGCCCTGGGACCAAAGTGGATATCAAA |
| 67 | 1066 | 1066 | DIVMTQTPGTLSVSPGERATLSCRASQDVGINLAWYQQKPGQAPRLLIY GASTRATDVPAKFSGSGSGTDFTLTISSLQSEDFGVYYCQEYNDWPPQLS FGPGTKVDIK |
| 67 | 1067 | 1067 | RASQDVGINLA |
| 67 | 1068 | 1068 | AGGGCCAGTCAGGACGTTGGCATCAACTTAGCC |
| 67 | 1069 | 1069 | GASTRAT |
| 67 | 1070 | 1070 | GGTGCATCCACCAGGGCCACT |
| 67 | 1071 | 1071 | QEYNDWPPQLS |
| 67 | 1072 | 1072 | CAGGAGTATAATGACTGGCCTCCCCAGCTCTCT |

TABLE 6-continued

Informal Sequence Listing

| Antibody No. | Seq. Ref. No. | SEQ ID NO. | Sequence |
|---|---|---|---|
| 68 | 1073 | 1073 | CAGATCACCTTGAAGGAGTCTGGTCCTACGCTGGTGAAACCCACACA GACCCTCACACTGACCTGCACCCTCTCTGGGTTCTCACTCAGCACTCC TAGAATGGGTGTGGGCTGGATCCGTCAGCCCCCAGGAAAGGCCCTGG AGTGGCTTGCACTCATTGATTGGGATGATGATAGGCGCTACAGTCCAT CTCTGAAGACCAGGCTCACCATCACCAAGGACACTTCCAAAAATCAG GTGGTCCTTAGAATGACCGACATGGACCCTGTGGACACAGGCACATA TTACTGTGTACACAGCGATGTCTATACTACTGGTGGTTATTACTTGTA CTACTTTGACTACTGGGGCCAGGGAACCCTGGTCACCGTCTCCTCA |
| 68 | 1074 | 1074 | QITLKESGPTLVKPTQTLTLTCTLSGFSLSTPRMGVGWIRQPPGKALEWL ALIDWDDDRRYSPSLKTRLTITKDTSKNQVVLRMTDMDPVDTGTYYCV HSDVYTTGGYYLYYFDYWGQGTLVTVSS |
| 68 | 1075 | 1075 | FSLSTPRMGVG |
| 68 | 1076 | 1076 | TTCTCACTCAGCACTCCTAGAATGGGTGTGGGC |
| 68 | 1077 | 1077 | LIDWDDDRRYSPSLKT |
| 68 | 1078 | 1078 | CTCATTGATTGGGATGATGATAGGCGCTACAGTCCATCTCTGAAGACC |
| 68 | 1079 | 1079 | VHSDVYTTGGYYLYYFDY |
| 68 | 1080 | 1080 | GTACACAGCGATGTCTATACTACTGGTGGTTATTACTTGTACTACTTT GACTAC |
| 68 | 1081 | 1081 | GACATCCAGGTGACCCAGTCTCCATCCTCCCTGTCTGCATCTGTAGGA GACAGAGTCACCATCACTTGCCGGGCAAGTCAGACCATTCCCAGCTA TTTAAATTGGTATCAGCACAAACCAGGGAAAGCCCCTCAGCTCCTGA TCTATGCTGCATCCAATTTGCGAAGTGGGGTCCCACCGAGGTTCCGTG GCAGTGGATCTGGGACAGATTTCACTCTCACCGTCAGCAGTCTGCAA CCTGAAGATTTTGCAACTTACTTCTGTCAACAGAGTTACAGTAGCCCA TACACTTTTGGCCAGGGGACCAAGCTGGAGATCAAA |
| 68 | 1082 | 1082 | DIQVTQSPSSLSASVGDRVTITCRASQTIPSYLNWYQHKPGKAPQLLIYAA SNLRSGVPPRFRGSGSGTDFTLTVSSLQPEDFATYFCQQSYSSPYTFGQGT KLEIK |
| 68 | 1083 | 1083 | RASQTIPSYLN |
| 68 | 1084 | 1084 | CGGGCAAGTCAGACCATTCCCAGCTATTTAAAT |
| 68 | 1085 | 1085 | AASNLRS |
| 68 | 1086 | 1086 | GCTGCATCCAATTTGCGAAGT |
| 68 | 1087 | 1087 | QQSYSSPYT |
| 68 | 1088 | 1088 | CAACAGAGTTACAGTAGCCCATACACT |
| 69 | 1089 | 1089 | CAGGTCCAGCTGGTACAGTCTGGAACTGAGGTGAAGAAGCCTGGGGC CTCAGTGAAGGTCTCCTGCAAGGGCTCTGGTTACATGTTTGCAAATTT TGGTGTCAGCTGGGTGCGACAGGCCCCTGGACGAGGGCTTGAGTGGA TCGGATGGATCAGCGCTTACAATGGAAACACATACTATGGACGTGAG CAGGGCAGATTCACCATGACCACAGACACGAACACAGCCTACCTGGA GCTGACGAGTCTCAGATATGACGACACGGCCCTTTATTTCTGTGCGAG AGATTCGGGAGCGACGGCGGCTGGAATACTCTGGGACTATTGGGGCC AGGGAACCCTGGTCACCGTCTCCTCA |
| 69 | 1090 | 1090 | QVQLVQSGTEVKKPGASVKVSCKGSGYMFANFGVSWVRQAPGRGLEW IGWISAYNGNTYYGREQGRFTMTTDTNTAYLELTSLRYDDTALYFCARD SGATAAGILWDYWGQGTLVTVSS |
| 69 | 1091 | 1091 | YMFANFGVS |
| 69 | 1092 | 1092 | TACATGTTTGCAAATTTTGGTGTCAGC |
| 69 | 1093 | 1093 | WISAYNGNTYYGREQG |
| 69 | 1094 | 1094 | TGGATCAGCGCTTACAATGGAAACACATACTATGGACGTGAGCAGGGC |
| 69 | 1095 | 1095 | ARDSGATAAGILWDY |
| 69 | 1096 | 1096 | GCGAGAGATTCGGGAGCGACGGCGGCTGGAATACTCTGGGACTAT |

TABLE 6-continued

Informal Sequence Listing

| Antibody No. | Seq. Ref. No. | SEQ ID NO. | Sequence |
|---|---|---|---|
| 69 | 1097 | 1097 | GAAATTGTAATGACACAGTCTCCACTCTCCCTGCCCGTCACCCTTGGA CAGCCGGCCTCCATCTCCTGCAGGTCTAGTCAAAGCCTCGCATACACT GATGGAAGCACTTACTTGAATTGGTTTCACCAGAGGCCAGGCCAGTC TCCACGGCGCCTAATTTATAAGGTTTTTAACCGGGACTCTGGGGTCCC CGACAGATTCAGCGGCAGTGGGGCAGGCACTGATTTCACACTGACTA TCAGCAGGGTGGAGGCTGAGGATGTTGGGGTTTATTACTGCATGCAA GCTACACACTGGCCTCGGACGTTCGGCCAGGGGACCAAAGTGGATAT CAAA |
| 69 | 1098 | 1098 | EIVMTQSPLSLPVTLGQPASISCRSSQSLAYTDGSTYLNWFHQRPGQSPRR LIYKVFNRDSGVPDRFSGSGAGTDFTLTISRVEAEDVGVYYCMQATHWP RTFGQGTKVDIK |
| 69 | 1099 | 1099 | RSSQSLAYTDGSTYLN |
| 69 | 1100 | 1100 | AGGTCTAGTCAAAGCCTCGCATACACTGATGGAAGCACTTACTTGAAT |
| 69 | 1101 | 1101 | KVFNRDS |
| 69 | 1102 | 1102 | AAGGTTTTTAACCGGGACTCT |
| 69 | 1103 | 1103 | MQATHWPRT |
| 69 | 1104 | 1104 | ATGCAAGCTACACACTGGCCTCGGACG |
| 70 | 1105 | 1105 | CAGGTCCAGCTGGTACAGTCTGGAAGTGAGGTGAAGAAGCCTGGGGC CTCGGTGACGCTCTCCTGCAAGGCCTCAGGTTACAGGTTTTCCAACTA TGGTGTCAGCTGGGTGCGACAGGCCCCCGGACAAGGCCTAGAGTGGA TGGGATGGATCAGCGGTTACAATGGAAACATAAAGTATGGAAACAGT CTCCAGGGCAGAGTCACCCTGACCACAGACACGACCACGGCCTACAT GGAGGTGACGAGCCTAACATCTGACGACACGGCCGTGTATTACTGTG CGAGAGATGTCCCAGCTGACGGGGTCCACTTCATGGACGTCTGGGGC AAAGGGACCACGGTCACCGTCTCCTCA |
| 70 | 1106 | 1106 | QVQLVQSGSEVKKPGASVTLSCKASGYRFSNYGVSWVRQAPGQGLEW MGWISGYNGNIKYGNSLQGRVTLTTDTTTAYMEVTSLTSDDTAVYYCA RDVPADGVHFMDVWGKGTTVTVSS |
| 70 | 1107 | 1107 | YRFSNYGVS |
| 70 | 1108 | 1108 | TACAGGTTTTCCAACTATGGTGTCAGC |
| 70 | 1109 | 1109 | WISGYNGNIKYGNSLQG |
| 70 | 1110 | 1110 | TGGATCAGCGGTTACAATGGAAACATAAAGTATGGAAACAGTCTCCA GGGC |
| 70 | 1111 | 1111 | ARDVPADGVHFMDV |
| 70 | 1112 | 1112 | GCGAGAGATGTCCCAGCTGACGGGGTCCACTTCATGGACGTC |
| 70 | 1113 | 1113 | GAAATTGTATTGACGCAGTCTCCACTCTCCCTGCCCGTCACCCTTGGA CAGCCGGCCTCCATCTCCTGCAGGTCTAGTCAAAGCCTCGTCCACAGT GATACTAACACCTACTTGACCTGGTTTCAGCAGAGGCCAGGCCAATC TCCACGGCGCCTAATTTATAAGGTTTCTCACCGGGACTCTGGGGTCCC AGACAGATTCAGCGGCAGTGGGTCAGGCACAACTTTCACGCTGAAAA TCGCCAGGGTGGAGGCTGAGGATGTTGGGATTTATTACTGCATGGAG GGGTCACACTGGGCTCCGACTTTCGGCCAGGGGACCAAAGTGGATAT CAAA |
| 70 | 1114 | 1114 | EIVLTQSPLSLPVTLGQPASISCRSSQSLVHSDTNTYLTWFQQRPGQSPRR LIYKVSHRDSGVPDRFSGSGSGTTFTLKIARVEAEDVGIYYCMEGSHWAP TFGQGTKVDIK |
| 70 | 1115 | 1115 | RSSQSLVHSDTNTYLT |
| 70 | 1116 | 1116 | AGGTCTAGTCAAAGCCTCGTCCACAGTGATACTAACACCTACTTGACC |
| 70 | 1117 | 1117 | KVSHRDS |
| 70 | 1118 | 1118 | AAGGTTTCTCACCGGGACTCT |
| 70 | 1119 | 1119 | MEGSHWAPT |

TABLE 6-continued

Informal Sequence Listing

| Antibody No. | Seq. Ref. No. | SEQ ID NO. | Sequence |
|---|---|---|---|
| 70 | 1120 | 1120 | ATGGAGGGGTCACACTGGGCTCCGACT |
| 71 | 1121 | 1121 | CAGGTGCAGCTACAGCAGTGGGGGGCCGAGGTGAAGAAGCCTGGGT CATCGGTGAAGGTCTCCTGCAAGGCTTCTGGAGTCGCCTTGAGCAGC GTTGCAATCAGCTGGGTGCGACAGGCCCCTGGACAAGGGCTTGAGTG GATGGGAGGGATCCTCCCTGGGTTTGACAAGGTCAGATTTGCCCAGG AGTTTGAGAATAGAGCCACTCTAACCGCGGACACAGCTAGGGATATA GCCTACATGGAGTTGAGCGGACTGAGATCTGACGACACGGCCGTCTA CTACTGTGCGATAATCGACCCCCAAGATTGCACTAGTGCCAGCTGCTT TTGGGTCAACTGGCTCGACCCCTGGGGCCAGGGAACCCTGGTCACCG TCTCCTCA |
| 71 | 1122 | 1122 | QVQLQQWGAEVKKPGSSVKVSCKASGVALSSVAISWVRQAPGQGLEW MGGILPGFDKVRFAQEFENRATLTADTARDIAYMELSGLRSDDTAVYYC AIIDPQDCTSASCFWVNWLDPWGQGTLVTVSS |
| 71 | 1123 | 1123 | VALSSVAIS |
| 71 | 1124 | 1124 | GTCGCCTTGAGCAGCGTTGCAATCAGC |
| 71 | 1125 | 1125 | GILPGFDKVRFAQEFEN |
| 71 | 1126 | 1126 | GGGATCCTCCCTGGGTTTGACAAGGTCAGATTTGCCCAGGAGTTTGA GAAT |
| 71 | 1127 | 1127 | AIIDPQDCTSASCFWVNWLDP |
| 71 | 1128 | 1128 | GCGATAATCGACCCCCAAGATTGCACTAGTGCCAGCTGCTTTTGGGTC AACTGGCTCGACCCC |
| 71 | 1129 | 1129 | GAAACGACACTCACGCAGTCTCCAGGCACCCTGACCGTGTCTCCAGG GGAGAGAGCCACCCTCTCCTGCAGGGCCAGTCAGAGTATTATTAGAA ACAACCTAGCCTGGTACCAGCAGAAACCTGGCCAGGCTCCCAGGCTC CTCATCTATGCTGCATCCAATAGGGCCACTGACATCCCAGACAGGTTC AGTGGCAGTGGGTCTGGGACAGACTTCACTCTCACCATCAGCAGACT GGAAGCACAAGATTTTGCAGTGTATTTCTGTCAGCAGTATGGTACCTC TCCGATCACCTTCGGCCAAGGGACCAAGGTGGAAATCAAA |
| 71 | 1130 | 1130 | ETTLTQSPGTLTVSPGERATLSCRASQSIIRNNLAWYQQKPGQAPRLLIYA ASNRATDIPDRFSGSGSGTDFTLTISRLEAQDFAVYFCQQYGTSPITFGQG TKVEIK |
| 71 | 1131 | 1131 | RASQSIIRNNLA |
| 71 | 1132 | 1132 | AGGGCCAGTCAGAGTATTATTAGAAACAACCTAGCC |
| 71 | 1133 | 1133 | AASNRAT |
| 71 | 1134 | 1134 | GCTGCATCCAATAGGGCCACT |
| 71 | 1135 | 1135 | QQYGTSPIT |
| 71 | 1136 | 1136 | CAGCAGTATGGTACCTCTCCGATCACC |
| 72 | 1137 | 1137 | GAGGTGCAGCTGTTGGAGTCTGGGGCTGAGGTGAAGAAGCCTGGGTC CTCGGTGAAGGTCTCCTGCAAGGTTGCCGGAGGAACCTTCAGCGACT ACGCCATCAGCTGGGTGCGACAGGCCCCTGGTCAAGGGCTGGAGTAC TTGGGAGGGATCATTCCTGCCTTTAAAAGAGCAATGTATCCACGGAA GTTTCAAGACAGAGTCACCATTACCGCGGACGAGTCCACGAGCACTG CCTACATGGAGCTGAGAGGCCTGAGATCTGAAGACACGGCCCTGTAT TATTGTGCGAGACCTGCTGGAGACTTTGGCGATTTAAAGTGGCTACG ATCGCCTTTTGACTACTGGGGCCAGGGAACCCTGGTCACCGTCTCCTCA |
| 72 | 1138 | 1138 | EVQLLESGAEVKKPGSSVKVSCKVAGGTFSDYAISWVRQAPGQGLEYLG GIIPAFKRAMYPRKFQDRVTITADESTSTAYMELRGLRSEDTALYYCARP AGDFGDLKWLRSPFDYWGQGTLVTVSS |
| 72 | 1139 | 1139 | GTFSDYAIS |
| 72 | 1140 | 1140 | GGAACCTTCAGCGACTACGCCATCAGC |
| 72 | 1141 | 1141 | GIIPAFKRAMYPRKFQD |

TABLE 6-continued

Informal Sequence Listing

| Antibody No. | Seq. Ref. No. | SEQ ID NO. | Sequence |
|---|---|---|---|
| 72 | 1142 | 1142 | GGGATCATTCCTGCCTTTAAAAGAGCAATGTATCCACGGAAGTTTCA<br>AGAC |
| 72 | 1143 | 1143 | ARPAGDFGDLKWLRSPFDY |
| 72 | 1144 | 1144 | GCGAGACCTGCTGGAGACTTTGGCGATTTAAAGTGGCTACGATCGCC<br>TTTTGACTAC |
| 72 | 1145 | 1145 | GATATTGTGCTGACTCAGTCTCCAGCCACCCTGTCTGTGTCTCCAGGG<br>GAAAGAGCCACGCTCTCCTGCAGGGCCAGTGAGGGTGTAGGCATCAA<br>CTTAGCCTGGTACCAGCAGAAACCTGGCCAGGCTCCCAGGCTCCTCA<br>TCTATGGTGCATCGACCAGGGCCACTGATATCCCAGCCAGGTTCAGT<br>GGCAGTGGGTCTGGGACAGACTTCACTCTCACCATCAGCAGCCTGCA<br>ATCTGAAGATTTTGCAGTTTATTATTGTCAGCAGTATAATGATTGGCC<br>TCCCCAGCTCACTTTCGGCCCTGGGACCAAAGTGGATATCAAA |
| 72 | 1146 | 1146 | DIVLTQSPATLSVSPGERATLSCRASEGVGINLAWYQQKPGQAPRLLIYG<br>ASTRATDIPARFSGSGSGTDFTLTISSLQSEDFAVYYCQQYNDWPPQLTF<br>GPGTKVDIK |
| 72 | 1147 | 1147 | RASEGVGINLA |
| 72 | 1148 | 1148 | AGGGCCAGTGAGGGTGTAGGCATCAACTTAGCC |
| 72 | 1149 | 1149 | GASTRAT |
| 72 | 1150 | 1150 | GGTGCATCGACCAGGGCCACT |
| 72 | 1151 | 1151 | QQYNDWPPQLT |
| 72 | 1152 | 1152 | CAGCAGTATAATGATTGGCCTCCCCAGCTCACT |
| 73 | 1153 | 1153 | GAGGTGCAGCTGGTGGAGTCTGGGGCTGAGGTGAAGAAGCCTGGGTC<br>CTCGGTGAAGGTCTCCTGTAAGGTTGTCGGAGGCAGTTTCAGCAACT<br>ATGGTATCAGCTGGGTGCGACAGGCCCCTGGACAGGGGCCTGAGTGG<br>ATGGGCGGGATCATCCCTGCCTTTAAGACAGCAAAATATGCAAAGAA<br>GTTCGAGGACAGAGTCACAATTACCGCGGACGAATCCACGAGCACTG<br>CCTACATGGAGGTGAGCGGCCTGAGATCTGACGACACGGCCCTGTAT<br>TATTGTGCGAGGCCTGAACGAGACTTTGGGCATTTAAAGTGGCTACG<br>CTCGCCTTTTGACTACTGGGGCCAGGGAACCCTGGTCACCGTCTCCTCA |
| 73 | 1154 | 1154 | EVQLVESGAEVKKPGSSVKVSCKVVGGSFSNYGISWVRQAPGQGPEWM<br>GGIIPAFKTAKYAKKFEDRVTITADESTSTAYMEVSGLRSDDTALYYCAR<br>PERDFGHLKWLRSPFDYWGQGTLVTVSS |
| 73 | 1155 | 1155 | GSFSNYGIS |
| 73 | 1156 | 1156 | GGCAGTTTCAGCAACTATGGTATCAGC |
| 73 | 1157 | 1157 | GIIPAFKTAKYAKKFED |
| 73 | 1158 | 1158 | GGGATCATCCCTGCCTTTAAGACAGCAAAATATGCAAAGAAGTTCGA<br>GGAC |
| 73 | 1159 | 1159 | ARPERDFGHLKWLRSPFDY |
| 73 | 1160 | 1160 | GCGAGGCCTGAACGAGACTTTGGGCATTTAAAGTGGCTACGCTCGCC<br>TTTTGACTAC |
| 73 | 1161 | 1161 | GAAACGACACTCACGCAGTCTCCAGCCACCCTGTCTGTGTCTCCAGG<br>GGAAAGAGTCACCCTCTCCTGCAGGGCCAGTCAGGGTGTTAGCATCA<br>ACTTAGCCTGGTACCAGCAGAAACCTGGCCAGGCTCCCAGGCTCCTC<br>ATCTATGGTGCATCCACCAGGGCCACTGATATCCCAGCCAGGTTCAGT<br>GGCAGTGGGTCTGGGACAGACTTCACTCTCACCATCAGCAGCCTGCA<br>GTCTGAAGATTTTGCAGTTTATTATTGTCAGCAGTATAATGACTGGCC<br>TCCCCAGCTCACTTTCGGCCCTGGGACCAAGGTGGAAATCAAA |
| 73 | 1162 | 1162 | ETTLTQSPATLSVSPGERVTLSCRASQGVSINLAWYQQKPGQAPRLLIYG<br>ASTRATDIPARFSGSGSGTDFTLTISSLQSEDFAVYYCQQYNDWPPQLTF<br>GPGTKVEIK |
| 73 | 1163 | 1163 | RASQGVSINLA |
| 73 | 1164 | 1164 | AGGGCCAGTCAGGGTGTTAGCATCAACTTAGCC |

TABLE 6-continued

Informal Sequence Listing

| Antibody No. | Seq. Ref. No. | SEQ ID NO. | Sequence |
|---|---|---|---|
| 73 | 1165 | 1165 | GASTRAT |
| 73 | 1166 | 1166 | GGTGCATCCACCAGGGCCACT |
| 73 | 1167 | 1167 | QQYNDWPPQLT |
| 73 | 1168 | 1168 | CAGCAGTATAATGACTGGCCTCCCCAGCTCACT |
| 74 | 1169 | 1169 | CAGGTCCAGCTGGTGCAGTCTGGGTCTGAGGTGAAGAGGCCTGGGTC ATCGGTGAAGGTCTCCTGCAAGGCCTCAGGAGTCGCTTTGACCACCG TTGCTGTCAACTGGGTGCGCCAGGTCCCTGGGCAAGGGCCTGAGTGG ATTGGAGGGATCCTCATTGGGTTTGGTAAGGTCAGACAGGCCCAGAA ATTTGAGAACCGAGTCACTTTTACCGCGGACGCATCTAGGAACACAG CCTACATGGAGTTGAGCGGACTGAGATCTGAGGACACGGCCGTCTAT TACTGTGCGATAATCGACCCCCAAGATTGTACTCGTGCCAGTTGCTTT TGGGTCAACTGGCTCGCCCCCTGGGGCCACGGAACCCTGGTCACCGT CTCCTCA |
| 74 | 1170 | 1170 | QVQLVQSGSEVKRPGSSVKVSCKASGVALTTVAVNWVRQVPGQGPEWI GGILIGFGKVRQAQKFENRVTFTADASRNTAYMELSGLRSEDTAVYYCA IIDPQDCTRASCFWVNWLAPWGHGTLVTVSS |
| 74 | 1171 | 1171 | VALTTVAVN |
| 74 | 1172 | 1172 | GTCGCTTTGACCACCGTTGCTGTCAAC |
| 74 | 1173 | 1173 | GILIGFGKVRQAQKFEN |
| 74 | 1174 | 1174 | GGGATCCTCATTGGGTTTGGTAAGGTCAGACAGGCCCAGAAATTTGA GAAC |
| 74 | 1175 | 1175 | AIIDPQDCTRASCFWVNWLAP |
| 74 | 1176 | 1176 | GCGATAATCGACCCCCAAGATTGTACTCGTGCCAGTTGCTTTTGGGTC AACTGGCTCGCCCCC |
| 74 | 1177 | 1177 | GACATCCGGGTGACCCAGTCTCCAGGCACCCTGACCTTGTCCCCAGG GGAGAGAGCCTCCCTCTCCTGCAGGGCCAGTGAGAGTATTCTTAACG GGAACTTAGCCTGGTACCAACAGAAACCTGGCCAGGCTCCCAGGCTC CTCATCTATGCTGCTTCCAGTAGGGCCACTGACATCCCAGACAGGTTC AGTGGCAGTGGGTCTGGGACAGACTTCACTCTCACCATCAGCAGACT GGAGCCTCAAGATTTTGCAGTCTATTATTGTCAGCAGTATGGTTCGGC TCCGATCACCTTCGGCCAAGGGACACGACTGGAGATTAAA |
| 74 | 1178 | 1178 | DIRVTQSPGTLTLSPGERASLSCRASESILNGNLAWYQQKPGQAPRLLIYA ASSRATDIPDRFSGSGSGTDFTLTISRLEPQDFAVYYCQQYGSAPITFGQG TRLEIK |
| 74 | 1179 | 1179 | RASESILNGNLA |
| 74 | 1180 | 1180 | AGGGCCAGTGAGAGTATTCTTAACGGGAACTTAGCC |
| 74 | 1181 | 1181 | AASSRAT |
| 74 | 1182 | 1182 | GCTGCTTCCAGTAGGGCCACT |
| 74 | 1183 | 1183 | QQYGSAPIT |
| 74 | 1184 | 1184 | CAGCAGTATGGTTCGGCTCCGATCACC |
| 75 | 1185 | 1185 | CAGGTCCAGCTTGTACAGTCTGGAAGTGAGGTGAAGAAGCCTGGGGC CTCGGTGACGGTCTCCTGCAAGGCCTCAGGTTACAGGTTTTCCAACTA TGGTGTCAGCTGGGTGCGACAGGCCCCTGGACAAGGCCTAGAGTGGA TGGGATGGATCAGCGCTTACAATGGAAACACAAAGTATGGAAATAGT CTCCAGGGCAGAGTCACCCTGACCACAGACACGACCACGGCCTACAT GGAGGTGAGGAGCCTGACATCTGACGACACGGCCGTGTATTACTGTG CGAGAGATGTCCCAGGTGACGGGGTCCACTTCATGGACGTCTGGGGC AAAGGGACCACGGTCACCGTCTCCTCA |
| 75 | 1186 | 1186 | QVQLVQSGSEVKKPGASVTVSCKASGYRFSNYGVSWVRQAPGQGLEW MGWISAYNGNTKYGNSLQGRVTLTTDTTTAYMEVRSLTSDDTAVYYCA RDVPGDGVHFMDVWGKGTTVTVSS |

TABLE 6-continued

Informal Sequence Listing

| Antibody No. | Seq. Ref. No. | SEQ ID NO. | Sequence |
|---|---|---|---|
| 75 | 1187 | 1187 | YRFSNYGVS |
| 75 | 1188 | 1188 | TACAGGTTTTCCAACTATGGTGTCAGC |
| 75 | 1189 | 1189 | WISAYNGNTKYGNSLQG |
| 75 | 1190 | 1190 | TGGATCAGCGCTTACAATGGAAACACAAAGTATGGAAATAGTCTCCAGGGC |
| 75 | 1191 | 1191 | ARDVPGDGVHFMDV |
| 75 | 1192 | 1192 | GCGAGAGATGTCCCAGGTGACGGGGTCCACTTCATGGACGTC |
| 75 | 1193 | 1193 | GAAATTGTGATGACGCAGTCTCCACTCTCCCTGCCCGTCACCCTTGGACAGTCGGCCTCCATCTCCTGCAGGTCGAGTCAAAGCCTCGTACACAGTGATACTAACACCTACTTGACCTGGTTTCAGCAGAGGCCAGGCCAATCTCCACGGCGCCTCATTTATAAGGTTTCTCACCGGGACTCTGGGGTCCCAGACAGATTCAGCGGCAGTGGGTCAGGCACTACTTTTACACTGAAAATCAGCAGGGTGGAGGCTGAGGATGTTGGAATTTATTACTGCATGGAGGGTTCACACTGGGCTCCGACTTTCGGCCAGGGGACCAAGGTGGAAATCAAA |
| 75 | 1194 | 1194 | EIVMTQSPLSLPVTLGQSASISCRSSQSLVHSDTNTYLTWFQQRPGQSPRRLIYKVSHRDSGVPDRFSGSGSGTTFTLKISRVEAEDVGIYYCMEGSHWAPTFGQGTKVEIK |
| 75 | 1195 | 1195 | RSSQSLVHSDTNTYLT |
| 75 | 1196 | 1196 | AGGTCGAGTCAAAGCCTCGTACACAGTGATACTAACACCTACTTGACC |
| 75 | 1197 | 1197 | KVSHRDS |
| 75 | 1198 | 1198 | AAGGTTTCTCACCGGGACTCT |
| 75 | 1199 | 1199 | MEGSHWAPT |
| 75 | 1200 | 1200 | ATGGAGGGTTCACACTGGGCTCCGACT |
| 76 | 1201 | 1201 | CAGGTCCAGCTTGTGCAGTCTGGGGGAGGCGTTGTCCAGCCTGGGAGCTCCCTGAGACTCTCCTGTTCAGCGTCTGGATTTACCTTCATGACCTATGGCATGCACTGGGCCCGCCAGGCTCCAGGCAAGGGGCTGGAGTGGGTCGCAGATATTTCCTTTGATGCAAATAAGAAATACTATAGAGATTCCGTGAAGGGCCGATTCACCATCTCCAGGGACAATTCCAAGAACACGGTGTATCTGCAAATGAACAGCCTGAGACCCGAGGACACGGCTGTCTACTTCTGTGCGAGAAATACGATTTTTGGAGTAGTTGACTACTGGGGCCAGGGAACCCTGGTCACCGTCTCCTCA |
| 76 | 1202 | 1202 | QVQLVQSGGGVVQPGSSLRLSCSASGFTFMTYGMHWARQAPGKGLEWVADISFDANKKYYRDSVKGRFTISRDNSKNTVYLQMNSLRPEDTAVYFCARNTIFGVVDYWGQGTLVTVSS |
| 76 | 1203 | 1203 | FTFMTYGMH |
| 76 | 1204 | 1204 | TTTACCTTCATGACCTATGGCATGCAC |
| 76 | 1205 | 1205 | DISFDANKKYYRDSVKG |
| 76 | 1206 | 1206 | GATATTTCCTTTGATGCAAATAAGAAATACTATAGAGATTCCGTGAAGGGC |
| 76 | 1207 | 1207 | ARNTIFGVVDY |
| 76 | 1208 | 1208 | GCGAGAAATACGATTTTTGGAGTAGTTGACTAC |
| 76 | 1209 | 1209 | GAAATTGTATTGACACAGTCTCCAGCCACCCTGTCTGTGTCTCCAGGGGAAAGAGCCACCCTCTCCTGCAGGGCCAGTCAGAGTGTTAGCGCCAACTTAGCCTGGTACCAGCAGAAACCTGGCCAGGCTCCCAGGCTCCTCATCTATGGTGCGTCCACCAGGGCAGTGATATCCCAGCCAGGTTCAGTGGCAGTGGGTCTGGGACAGAGTTCACTCTCACCATCAGCAGCCTGCAGTCTGAAGATTCTGCAGTTATTACTGTCAGCAGTATAATAACTGGCCTCCGTGGACGTTCGGCCAAGGGACCAAGGTGGAAATCAAA |

TABLE 6-continued

Informal Sequence Listing

| Antibody No. | Seq. Ref. No. | SEQ ID NO. | Sequence |
|---|---|---|---|
| 76 | 1210 | 1210 | EIVLTQSPATLSVSPGERATLSCRASQSVSANLAWYQHKPGQAPRLLIYG ASTRASDIPARFSGSGSGTEFTLTISSLQSEDSAVYYCQQYNNWPPWTFG QGTKVEIK |
| 76 | 1211 | 1211 | RASQSVSANLA |
| 76 | 1212 | 1212 | AGGGCCAGTCAGAGTGTTAGCGCCAACTTAGCC |
| 76 | 1213 | 1213 | GASTRAS |
| 76 | 1214 | 1214 | GGTGCGTCCACCAGGGCCAGT |
| 76 | 1215 | 1215 | QQYNNWPPWT |
| 76 | 1216 | 1216 | CAGCAGTATAATAACTGGCCTCCGTGGACG |
| 77 | 1217 | 1217 | CAGGTCCAGCTGGTGCAGTCTGGAGTTGAGGTGAAGAAGCCTGGGGC CTCAGTGAAGGTCTCCTGCAAGACTTCTGGTTACACCTTTAGTAATTA TGGTGTCACCTGGGTGCGACAGGCCCCTGGACAAGGGCTTGAGTACA TGGGATGGATCAGCGCTTACAATGGTAACACAAACTATGCCCAGAAT GTCCAGGGTCGACTCACCATGACCACAGACACATCCACGAGCACAGG CTACATGGAGTTGAGGAGGCTGACATCTGACGACACGGCCGTGTATT TCTGTGCGAGAGATAAAGGTGTAACAGTGGCCGGTTCATTGCTTGAC TACTGGGGCCAGGGAACCCTGGTCACCGTCTCCTCA |
| 77 | 1218 | 1218 | QVQLVQSGVEVKKPGASVKVSCKTSGYTFSNYGVTWVRQAPGQGLEY MGWISAYNGNTNYAQNVQGRLTMTTDTSTSTGYMELRRLTSDDTAVYF CARDKGVTVAGSLLDYWGQGTLVTVSS |
| 77 | 1219 | 1219 | YTFSNYGVT |
| 77 | 1220 | 1220 | TACACCTTTAGTAATTATGGTGTCACC |
| 77 | 1221 | 1221 | WISAYNGNTNYAQNVQG |
| 77 | 1222 | 1222 | TGGATCAGCGCTTACAATGGTAACACAAACTATGCCCAGAATGTCCA GGGT |
| 77 | 1223 | 1223 | ARDKGVTVAGSLLDY |
| 77 | 1224 | 1224 | GCGAGAGATAAAGGTGTAACAGTGGCCGGTTCATTGCTTGACTAC |
| 77 | 1225 | 1225 | GAAATTGTGATGACACAGTCTCCACTCTCCCTGCCCGTCACCCTTGGA CAGCCGGCCTCCATCTCCTGCAGGTCTAGTCAAAGTCTCGAACATAGT GATGGAAACACCTACTTGAATTGGTTTCAGCAGAGGCCAGGCCAATC TCCAAGGCGCCTCATTTATAAGGTTTCTAACCGGGACTCTGGGGTCCC AGACAGATTCAGCGGCAGTGGGTCAGGCACTGATTTCACACTGAAAA TCAACAGGGTGGAGGCTGAGGATGTTGGGGTTTATTACTGCATGGAA AGTACACACTGGCCTCCGTACACTTTTGGCCAGGGGACCAAGGTGGA GATCAAA |
| 77 | 1226 | 1226 | EIVMTQSPLSLPVTLGQPASISCRSSQSLEHSDGNTYLNWFQQRPGQSPRR LIYKVSNRDSGVPDRFSGSGSGTDFTLKINRVEAEDVGVYYCMESTHWP PYTFGQGTKVEIK |
| 77 | 1227 | 1227 | RSSQSLEHSDGNTYLN |
| 77 | 1228 | 1228 | AGGTCTAGTCAAAGTCTCGAACATAGTGATGGAAACACCTACTTGAAT |
| 77 | 1229 | 1229 | KVSNRDS |
| 77 | 1230 | 1230 | AAGGTTTCTAACCGGGACTCT |
| 77 | 1231 | 1231 | MESTHWPPYT |
| 77 | 1232 | 1232 | ATGGAAAGTACACACTGGCCTCCGTACACT |
| 78 | 1233 | 1233 | CAGGTCCAGCTGGTGCAGTCTGGACCTGAGGTGAAGAAGCCTGGGGC CTCAGTGCGGGTCTCCTGCAAGACTTCTGGTTTCACCTTGTCCCATTA TGGTGTCAGTTGGCTGCGGCAGGCCCCTGGACACGGACTTGAGTGGC TGGGCTGGATCAGCGCTTACAACTATAACACACAATTTGGACACAGA ATGGAGGGCAGGCTCACCATGACCACAGACACTTCCACAGCCTATAT GGACCTGACGAGCCTGACTTCTGACGACACGGCCATATATTACTGTG |

TABLE 6-continued

Informal Sequence Listing

| Antibody No. | Seq. Ref. No. | SEQ ID NO. | Sequence |
|---|---|---|---|
| | | | CGAGAGATTCCCCTTCAGACACAGCGGCAGCACTCCTTGACTTCTGG<br>GGCCAGGGAACCCTGGTCACCGTCTCCTCA |
| 78 | 1234 | 1234 | QVQLVQSGPEVKKPGASVRVSCKTSGFTLSHYGVSWLRQAPGHGLEWL<br>GWISAYNYNTQFGHRMEGRLTMTTDTSTAYMDLTSLTSDDTAIYYCAR<br>DSPSDTAAALLDFWGQGTLVTVSS |
| 78 | 1235 | 1235 | FTLSHYGVS |
| 78 | 1236 | 1236 | TTCACCTTGTCCCATTATGGTGTCAGT |
| 78 | 1237 | 1237 | WISAYNYNTQFGHRMEG |
| 78 | 1238 | 1238 | TGGATCAGCGCTTACAACTATAACACACAATTTGGACACAGAATGGA<br>GGGC |
| 78 | 1239 | 1239 | ARDSPSDTAAALLDF |
| 78 | 1240 | 1240 | GCGAGAGATTCCCCTTCAGACACAGCGGCAGCACTCCTTGACTTC |
| 78 | 1241 | 1241 | GATATTGTGCTGACTCAGTCTCCCCTCTCCTGCCCGTCACTCTTGGA<br>CAGCCGGCCTCCATCTCCTGCAGGTCTAGTCAAAGCCTCGTATACAGT<br>GATGGCAACACCTACTTGAGTTGGTTTCAGCAGAGGCCAGGCCAAGC<br>TCCAAGGCGCCTAATTTATAAGATTTCTAACCGAGACTCTGGGGTCCC<br>AGACAGATTCAGCGGCAGTGGGTCAGGCACTGATTTCACACTAAAGA<br>TCAGCAGGGTGGAGGCTGAGGATGTTGGGATTTATTACTGCATGCAA<br>GCTACACACTGGCCTCGTCTCAGTTTCGGCGGAGGGACCAAGGTGGA<br>GATCAAA |
| 78 | 1242 | 1242 | DIVLTQSPLSLPVTLGQPASISCRSSQSLVYSDGNTYLSWFQQRPGQAPRR<br>LIYKISNRDSGVPDRFSGSGSGTDFTLKISRVEAEDVGIYYCMQATHWPR<br>LSFGGGTKVEIK |
| 78 | 1243 | 1243 | RSSQSLVYSDGNTYLS |
| 78 | 1244 | 1244 | AGGTCTAGTCAAAGCCTCGTATACAGTGATGGCAACACCTACTTGAGT |
| 78 | 1245 | 1245 | KISNRDS |
| 78 | 1246 | 1246 | AAGATTTCTAACCGAGACTCT |
| 78 | 1247 | 1247 | MQATHWPRLS |
| 78 | 1248 | 1248 | ATGCAAGCTACACACTGGCCTCGTCTCAGT |
| 79 | 1249 | 1249 | GAGGTGCAGCTGGTGGAGTCTGGGGCTGAAATGAAGCAGCCTGGGGC<br>CTCAGTGAAAGTCTCCTGCGAGGGTTTTGGAAACACTCTCAGTGAAA<br>GATCCATACACTGGGTGCGACAGGCTCCAGGAAAAGGGCCTGAGTGG<br>ATGGGAGATTATGATCATGAAGATAAAGAAGCAATCTACGCACCGAA<br>GTTCCAGGGCAGACTCACAATAAGCGCGGACATGTCTACAGACATAG<br>CCTCCTTGGAGCTGAACAGCTGACATCAGAAGACACAGCCGTCTAT<br>TATTGTGCGACAGTGATCGCTGTGGGGGCTTATGACATCTGGGGCCA<br>GGGAACCCTGGTCACCGTCTCCTCA |
| 79 | 1250 | 1250 | EVQLVESGAEMKQPGASVKVSCEGFGNTLSERSIHWVRQAPGKGPEWM<br>GDYDHEDKEAIYAPKFQGRLTISADMSTDIASLELNSLTSEDTAVYYCAT<br>VIAVGAYDIWGQGTLVTVSS |
| 79 | 1251 | 1251 | NTLSERSIH |
| 79 | 1252 | 1252 | AACACTCTCAGTGAAAGATCCATACAC |
| 79 | 1253 | 1253 | DYDHEDKEAIYAPKFQG |
| 79 | 1254 | 1254 | GATTATGATCATGAAGATAAAGAAGCAATCTACGCACCGAAGTTCCA<br>GGGC |
| 79 | 1255 | 1255 | ATVIAVGAYDI |
| 79 | 1256 | 1256 | GCGACAGTGATCGCTGTGGGGGCTTATGACATC |
| 79 | 1257 | 1257 | GAAATTGTATTGACACAGTCTCCATCCTCCCTGTATGCGTCTATAGGG<br>GACAGAGTCACCATCACTTGCCGGACTGGTCAGAGCATTTCCCGGTA<br>TTTGAATTGGTATCAGCAGAAACCTGGGAAAGCCCCTAAACTCCTGA |

TABLE 6-continued

Informal Sequence Listing

| Antibody No. | Seq. Ref. No. | SEQ ID NO. | Sequence |
|---|---|---|---|
| | | | TCTATGCAGCATCCACTTTGCAAAGTGGGGTCCCATCACGTTTCAGTG<br>GCAGTGGCGCTGGGACAGATTTCACTCTCACCATCAGAGGTCTGCTA<br>CCTGAAGATTTTGCAACTTACTTCTGTCAACAGAGTTACATTATCCCC<br>TACACTTTTGGCCAGGGGACCAAGGTGGAAATCAAA |
| 79 | 1258 | 1258 | EIVLTQSPSSLYASIGDRVTITCRTGQSISRYLNWYQQKPGKAPKLLIYAA<br>STLQSGVPSRFSGSGAGTDFTLTIRGLLPEDFATYFCQQSYIIPYTFGQGTK<br>VEIK |
| 79 | 1259 | 1259 | RTGQSISRYLN |
| 79 | 1260 | 1260 | CGGACTGGTCAGAGCATTTCCCGGTATTTGAAT |
| 79 | 1261 | 1261 | AASTLQS |
| 79 | 1262 | 1262 | GCAGCATCCACTTTGCAAAGT |
| 79 | 1263 | 1263 | QQSYIIPYT |
| 79 | 1264 | 1264 | CAACAGAGTTACATTATCCCCTACACT |
| 80 | 1265 | 1265 | CAGGTGCAGCTACAGCAGTGGGGCGCAGGACTGGTGAAGCCTTCGGA<br>GACCCTGTCCCTCACCTGCGCTGTGTATGGTGGGTCCTTCAGTGGTTA<br>CCAGTGGCACTGGTTCCGCCAGCCCCCAGGGAAGGGTCTGGAGTGGA<br>TTGGGGAAATCAATCATAGTGAAATCACCCACTACAACGCGTCCCTC<br>AAGAGTCGAGTCACCCTATCTATTGACACGTCCAAGAACCAATTCTCC<br>CTGAACCTGACCTCTGTGACCGCCGCGGACACGGCTGTTTATTACTGT<br>GCGAGAGCCTCGAGTGGGAGCTATAACTTCGAATACTGGTTCGACCC<br>CTGGGGCCAGGGAACCCTGGTCACCGTCTCCTCA |
| 80 | 1266 | 1266 | QVQLQQWGAGLVKPSETLSLTCAVYGGSFSGYQWHWFRQPPGKGLEWI<br>GEINHSEITHYNASLKSRVTLSIDTSKNQFSLNLTSVTAADTAVYYCARA<br>SSGSYNFEYWFDPWGQGTLVTVSS |
| 80 | 1267 | 1267 | GSFSGYQWH |
| 80 | 1268 | 1268 | GGGTCCTTCAGTGGTTACCAGTGGCAC |
| 80 | 1269 | 1269 | EINHSEITHYNASLKS |
| 80 | 1270 | 1270 | GAAATCAATCATAGTGAAATCACCCACTACAACGCGTCCCTCAAGAGT |
| 80 | 1271 | 1271 | ARASSGSYNFEYWFDP |
| 80 | 1272 | 1272 | GCGAGAGCCTCGAGTGGGAGCTATAACTTCGAATACTGGTTCGACCCC |
| 80 | 1273 | 1273 | CAGTCTGTGCTGACGCAGCCGCCCTCGGTGTCCGTGGCCCCAGGAAA<br>GACGGCCTGGCTTACCTGTGGGGGAAACAACATTGGCAGTAAGAGAG<br>TGCACTGGTACCGGCAGAAGCCAGGCCAGGCCCCTGTGCTGGTCGTT<br>TATGATGATTACGACCGGCCCTCAGGGACCCCTGAGCGAGTCTCTGG<br>CTCCAACTCTGGGAACACGGCCACCCTGACCATCAGCAGGGTCGAAG<br>ACGGGGATGAGGGCGACTATTATTGTCAGGTGTGGGATGATCCCAGT<br>GATCATGCGGTGTTCGGCGGCGGGACCAAGCTGACCGTCCTA |
| 80 | 1274 | 1274 | QSVLTQPPSVSVAPGKTAWLTCGGNNIGSKRVHWYRQKPGQAPVLVVY<br>DDYDRPSGTPERVSGSNSGNTATLTISRVEDGDEGDYYCQVWDDPSDHA<br>VFGGGTKLTVL |
| 80 | 1275 | 1275 | GGNNIGSKRVH |
| 80 | 1276 | 1276 | GGGGGAAACAACATTGGCAGTAAGAGAGTGCAC |
| 80 | 1277 | 1277 | DDYDRPS |
| 80 | 1278 | 1278 | GATGATTACGACCGGCCCTCA |
| 80 | 1279 | 1279 | QVWDDPSDHAV |
| 80 | 1280 | 1280 | CAGGTGTGGGATGATCCCAGTGATCATGCGGTG |
| 81 | 1281 | 1281 | CAGGTCCAGCTTGTGCAGTCTGGAACTGAGGTTAAGAAGCCTGGGGC<br>CTCAGTGAAGGTCTCCTGCTTGACTTCTGGCTACACCTTTACACACTT<br>TGGTATCAGCTGGGTGCGACAGGCCCCAGGACAAGGGCTTGAGTGGA<br>TGGGATGGTTCAGCGCTTACAATGGTAACACAAAGTATGCACAGAAG |

TABLE 6-continued

Informal Sequence Listing

| Antibody No. | Seq. Ref. No. | SEQ ID NO. | Sequence |
|---|---|---|---|
| | | | TTCCAGGGCAGAATCACCCTCACCATAGACACATCCACGAGCATCGC<br>CTACTTGGAACTGAGGAGCCTGAGATCTGACGACACGGCCGTATATT<br>ATTGTGCGAGAGACCCCCCGAGTCTGACAGCAGCTGGTACTCTGGAC<br>TACTGGGGCCAGGGAACCCTGGTCACCGTCTCCTCA |
| 81 | 1282 | 1282 | QVQLVQSGTEVKKPGASVKVSCLTSGYTFTHFGISWVRQAPGQGLEWM<br>GWFSAYNGNTKYAQKFQGRITLTIDTSTSIAYLELRSLRSDDTAVYYCAR<br>DPPSLTAAGTLDYWGQGTLVTVSS |
| 81 | 1283 | 1283 | YTFTHFGIS |
| 81 | 1284 | 1284 | TACACCTTTACACACTTTGGTATCAGC |
| 81 | 1285 | 1285 | WFSAYNGNTKYAQKFQG |
| 81 | 1286 | 1286 | TGGTTCAGCGCTTACAATGGTAACACAAAGTATGCACAGAAGTTCCA<br>GGGC |
| 81 | 1287 | 1287 | ARDPPSLTAAGTLDY |
| 81 | 1288 | 1288 | GCGAGAGACCCCCCGAGTCTGACAGCAGCTGGTACTCTGGACTAC |
| 81 | 1289 | 1289 | GACATCCGGTTGACCCAGTCTCCACTCTCCCTGCCCGTCACCCTTGGA<br>CAGCCGGCCTCCATCTCCTGCAGCTCTAATCAAAGCCTCGTATACAGT<br>GATGGAAACACCTACTTGAGTTGGTTTCAGCAGAGGCCAGGCCAATC<br>TCCAAGGCGCCTAATTTATAAGGTTTCTGATCGGGACTCTGGGGTCCC<br>AGACAGATTCAGCGGCAGTGGGTCAGGCACTGATTTCACACTGAAAA<br>TCAGCAGGGTGGAGGCTGAGGATGTTGGGGTTTATTACTGCATGCAA<br>GCTACAGACTGGCCCCGGACGTTCGGCCAAGGGACCAAGGTGGAGAT<br>CAAA |
| 81 | 1290 | 1290 | DIRLTQSPLSLPVTLGQPASISCSSNQSLVYSDGNTYLSWFQQRPGQSPRR<br>LIYKVSDRDSGVPDRFSGSGSGTDFTLKISRVEAEDVGVYYCMQATDWP<br>RTFGQGTKVEIK |
| 81 | 1291 | 1291 | SSNQSLVYSDGNTYLS |
| 81 | 1292 | 1292 | AGCTCTAATCAAAGCCTCGTATACAGTGATGGAAACACCTACTTGAGT |
| 81 | 1293 | 1293 | KVSDRDS |
| 81 | 1294 | 1294 | AAGGTTTCTGATCGGGACTCT |
| 81 | 1295 | 1295 | MQATDWPRT |
| 81 | 1296 | 1296 | ATGCAAGCTACAGACTGGCCCCGGACG |
| 82 | 1297 | 1297 | GAGGTGCAGCTGGTGGAGTCTGGGGCTGAGGTGAAGAAGCCTGGGG<br>ACTCAGTGAAGGTCTCCTGCAGGGCTTCTGGATACAGCTTCACCGGCC<br>CCTTTTTGCACTGGGTGCGACAGGCCCCTGGACAGCGGCTTGAGCAC<br>ATGGGATGGATCAACCCTAGAAGTGGTGAAACAAAATATGCACAGTC<br>CTTTCTGGGCAGGGTCACCATGACCAGGGACACGTCCATTCGCTCAG<br>CCACCTTGGAATTGAGTAGCCTGAGATCTGACGACACGGCCGTGTAT<br>TATTGTGCGAGAGACCTCTATAGCAGTGGCTGGCTCGACAACTGGGG<br>CCAGGGAACCCTGGTCACCGTCTCCTCA |
| 82 | 1298 | 1298 | EVQLVESGAEVKKPGDSVKVSCRASGYSFTGPFLHWVRQAPGQRLEHM<br>GWINPRSGETKYAQSFLGRVTMTRDTSIRSATLELSSLRSDDTAVYYCAR<br>DLYSSGWLDNWGQGTLVTVSS |
| 82 | 1299 | 1299 | YSFTGPFLH |
| 82 | 1300 | 1300 | TACAGCTTCACCGGCCCCTTTTTGCAC |
| 82 | 1301 | 1301 | WINPRSGETKYAQSFLG |
| 82 | 1302 | 1302 | TGGATCAACCCTAGAAGTGGTGAAACAAAATATGCACAGTCCTTTCT<br>GGGC |
| 82 | 1303 | 1303 | ARDLYSSGWLDN |
| 82 | 1304 | 1304 | GCGAGAGACCTCTATAGCAGTGGCTGGCTCGACAAC |

TABLE 6-continued

Informal Sequence Listing

| Antibody No. | Seq. Ref. No. | SEQ ID NO. | Sequence |
|---|---|---|---|
| 82 | 1305 | 1305 | GAAACGACACTCACGCAGTCTCCAGCCACCCTGTCTGTGTCTCCAGG<br>GGAAAGGGCCACCCTCTCCTGCAGGGCCAGTCAGGGTCTTAGCAGCA<br>ACTTAGCCTGGTACCAGCACAAACCTGGCCAGGCTCCCAGGCTCCTC<br>GTCTATGGTGTTGCCACCAGGGCCACTGGTGTCCCAGCCAGGTTCAGT<br>GGCAGTGGGTCTGGGACAGAGTTCACTCTCACCATCAGCAGCCTGCA<br>GTCTGACGATTTTGCACTTTATTACTGTCATCAGTATAATGACTGGCC<br>CTACACTTTTGGCCAGGGGACCAAGCTGGAGATCAAA |
| 82 | 1306 | 1306 | ETTLTQSPATLSVSPGERATLSCRASQGLSSNLAWYQHKPGQAPRLLVY<br>GVATRATGVPARFSGSGSGTEFTLTISSLQSDDFALYYCHQYNDWPYTF<br>GQGTKLEIK |
| 82 | 1307 | 1307 | RASQGLSSNLA |
| 82 | 1308 | 1308 | AGGGCCAGTCAGGGTCTTAGCAGCAACTTAGCC |
| 82 | 1309 | 1309 | GVATRAT |
| 82 | 1310 | 1310 | GGTGTTGCCACCAGGGCCACT |
| 82 | 1311 | 1311 | HQYNDWPYT |
| 82 | 1312 | 1312 | CATCAGTATAATGACTGGCCCTACACT |
| 83 | 1313 | 1313 | GAGGTGCAGCTGGTGGAGTCTGGGGGAGGCTTGGTAAAGCCTGGGGG<br>GTCCCTAAGACTCTCATGTGCAGCCTCTGGATTCATCTTCCGCAACGC<br>CTGGATGAGCTGGGTCCGCCAGGCTCCAGGGAAGGGGCTGGAGTGGG<br>TTGGCCGGATTAAAAGGACAAGTGAAGGTGGGTCAGTCGACTACGCG<br>ACACCCGTGCAAGGCAGATTCTCCATCTCAAGAGATGATTCTAGAAA<br>CACGCTGTATCTGCAAATGAACAGCCTGGAAACCGACGACACAGCCG<br>TGTATTACTGTTCCACAGGCCCACCCTACTCTTACTTTGATAGTAGTG<br>GTTATTCGGTCGTGGACTACTGGGGCCAGGGAACCCTGGTCACCGTCT<br>CCTCA |
| 83 | 1314 | 1314 | EVQLVESGGGLVKPGGSLRLSCAASGFIFRNAWMSWVRQAPGKGLEWV<br>GRIKRTSEGGSVDYATPVQGRFSISRDDSRNTLYLQMNSLETDDTAVYY<br>CSTGPPYSYFDSSGYSVVDYWGQGTLVTVSS |
| 83 | 1315 | 1315 | FIFRNAWMS |
| 83 | 1316 | 1316 | TTCATCTTCCGCAACGCCTGGATGAGC |
| 83 | 1317 | 1317 | RIKRTSEGGSVDYATPVQG |
| 83 | 1318 | 1318 | CGGATTAAAAGGACAAGTGAAGGTGGGTCAGTCGACTACGCGACACC<br>CGTGCAAGGC |
| 83 | 1319 | 1319 | STGPPYSYFDSSGYSVVDY |
| 83 | 1320 | 1320 | TCCACAGGCCCACCCTACTCTTACTTTGATAGTAGTGGTTATTCGGTC<br>GTGGACTAC |
| 83 | 1321 | 1321 | CAGTCTGTGTTGACGCAGCCGCCCTCAGCGTCTGGGACCCCCGGGCA<br>GAGGGTCACCATCTCTTGTTCTGCAAGCAGCTCCAACATCGGAGATA<br>ATTATTTCTACTGGTACCAACAACTCCCAGGAAAGGCCCCCACACTCC<br>TCATGTATGGTAGTGATCAGCGGTCCTCAGGGGTCCCTGACCGATTCT<br>CTGGCTCCCAGTCTGGCACCTCTGCCTCCCTGGCCATCAGTGGGCTCC<br>GGTCCGAGGATGAAGCTGATTATTATTGTGCAGCTTGGGATGACAGC<br>CTGAGTGGTCCGGTGTTCGGCGGAGGGACCAAGCTGACCGTCCTA |
| 83 | 1322 | 1322 | QSVLTQPPSASGTPGQRVTISCSASSSNIGDNYFYWYQQLPGKAPTLLMY<br>GSDQRSSGVPDRFSGSQSGTSASLAISGLRSEDEADYYCAAWDDSLSGPV<br>FGGGTKLTVL |
| 83 | 1323 | 1323 | SASSSNIGDNYFY |
| 83 | 1324 | 1324 | TCTGCAAGCAGCTCCAACATCGGAGATAATTATTTCTAC |
| 83 | 1325 | 1325 | GSDQRSS |
| 83 | 1326 | 1326 | GGTAGTGATCAGCGGTCCTCA |
| 83 | 1327 | 1327 | AAWDDSLSGPV |

TABLE 6-continued

Informal Sequence Listing

| Antibody No. | Seq. Ref. No. | SEQ ID NO. | Sequence |
|---|---|---|---|
| 83 | 1328 | 1328 | GCAGCTTGGGATGACAGCCTGAGTGGTCCGGTG |
| 84 | 1329 | 1329 | GAGGTGCAGCTGGTGGAGTCTGGGGGAGGCTTGGTACAGCCTGGGGG<br>GTCCCTGAGACTCTCGTGTGCAGCCTCTGGATTCTCCTTCAGTGACTA<br>CAGCATGAACTGGGTCCGCCAGGCTCCAGGGAAGGGGCTGGAGTGG<br>GTTTCATATATTACTCCTAGTAGTAGAAATAAATTCTATGCAGACTCT<br>GTGAGGGGCCGATTCACCATCTCCAGAGACAATGCCGAGAATTCACT<br>GTATCTGCAAATGAACAGCCTGAGAGTCGAAGACACGGCTGTTTATT<br>ACTGTGTCAGAAGTTTGCATTGGGGCGCCGCGATCGAGAGATGGGAC<br>GTCTGGGGCCAAGGGACCACGGTCACCGTCTCCTCA |
| 84 | 1330 | 1330 | EVQLVESGGGLVQPGGSLRLSCAASGFSFSDYSMNWVRQAPGKGLEWV<br>SYITPSSRNKFYADSVRGRFTISRDNAENSLYLQMNSLRVEDTAVYYCVR<br>SLHWGAAIERWDVWGQGTTVTVSS |
| 84 | 1331 | 1331 | FSFSDYSMN |
| 84 | 1332 | 1332 | TTCTCCTTCAGTGACTACAGCATGAAC |
| 84 | 1333 | 1333 | YITPSSRNKFYADSVRG |
| 84 | 1334 | 1334 | TATATTACTCCTAGTAGTAGAAATAAATTCTATGCAGACTCTGTGAGG<br>GGC |
| 84 | 1335 | 1335 | VRSLHWGAAIERWDV |
| 84 | 1336 | 1336 | GTCAGAAGTTTGCATTGGGGCGCCGCGATCGAGAGATGGGACGTC |
| 84 | 1337 | 1337 | GAAATTGTATTGACGCAGTCTCCAGGCACCCTGTCGTTGTCTCCAGGG<br>GAAAGAGCCACCCTCTCCTGCAGGGCCAGTCAGAGTATTAGCAGCAG<br>CTTCTTTGCCTGGTACCAGCAGAAACCTGGCCAGGCCCCCAGACTCCT<br>CATGTATGCTACATCCAGCAGGGCCACTGGCATCCCAGACAGGTTCA<br>GTGGCAGTGGGTCTGGGACAGACTTCACTCTCACCATCAGCAGAGTG<br>GAGCCTGAAGATTTTGCAGTGTATTACTGTCAGCAGTCTGGCAGTTCA<br>CCGTACACTTTTGGCCAGGGGACCAAGGTGGAAATCAAA |
| 84 | 1338 | 1338 | EIVLTQSPGTLSLSPGERATLSCRASQSISSSFFAWYQQTPGQAPRLLMYA<br>TSSRATGIPDRFSGSGSGTDFTLTISRVEPEDFAVYYCQQSGSSPYTFGQG<br>TKVEIK |
| 84 | 1339 | 1339 | RASQSISSSFFA |
| 84 | 1340 | 1340 | AGGGCCAGTCAGAGTATTAGCAGCAGCTTCTTTGCC |
| 84 | 1341 | 1341 | ATSSRAT |
| 84 | 1342 | 1342 | GCTACATCCAGCAGGGCCACT |
| 84 | 1343 | 1343 | QQSGSSPYT |
| 84 | 1344 | 1344 | CAGCAGTCTGGCAGTTCACCGTACACT |
| 85 | 1345 | 1345 | GAGGTGCAGCTGTTGGAGTCGGGGGGAGGCGTGGTCCAGCCTGGGAG<br>GTCCCTGAGACTCTCCTGTACAGCCTCTGGATTCACCTTCAGTGACCA<br>TGCTATGTACTGGGTCCGCCAGGCTCCAGGCAAAGGGCTAGAGTGGG<br>TGGCACTTATATCATTTGATGGAAGGAATATATACTACGCAGACTCCG<br>TGAAGGGCCGATTCACCATCTCCAGAGACAATTCCAAGAACACGCTG<br>TATCTGCAGATGAACAGCCTGAGAGCTGAGGACACGGCTGTCTATTA<br>CTGTGCGAGAGATCAATGGCTGGTTCCTGACTACTGGGGCCAGGGAA<br>CCCTGGTCACCGTCTCCTCA |
| 85 | 1346 | 1346 | EVQLLESGGGVVQPGRSLRLSCTASGFTFSDHAMYWVRQAPGKGLEWV<br>ALISFDGRNIYYADSVKGRFTISRDNSKNTLYLQMNSLRAEDTAVYYCA<br>RDQWLVPDYWGQGTLVTVSS |
| 85 | 1347 | 1347 | FTFSDHAMY |
| 85 | 1348 | 1348 | TTCACCTTCAGTGACCATGCTATGTAC |
| 85 | 1349 | 1349 | LISFDGRNIYYADSVKG |
| 85 | 1350 | 1350 | CTTATATCATTTGATGGAAGGAATATATACTACGCAGACTCCGTGAA<br>GGGC |

TABLE 6-continued

Informal Sequence Listing

| Antibody No. | Seq. Ref. No. | SEQ ID NO. | Sequence |
|---|---|---|---|
| 85 | 1351 | 1351 | ARDQWLVPDY |
| 85 | 1352 | 1352 | GCGAGAGATCAATGGCTGGTTCCTGACTAC |
| 85 | 1353 | 1353 | CAGTCTGTTCTGATTCAGCCTGCCTCCGTGTCTGGGTCTCCTGGACAG<br>TCGATCACCATCTCCTGCACTGGAACCAGCAGTGACGTTGGTGGTTAT<br>AACTATGTCTCCTGGTACCAACAGCACCCAGGCAACGCCCCCAAACT<br>CATGATTTATGAAGTCAGTAAGCGGCCCTCAGGGGTCCCTGATCGCTT<br>CTCTGGCTTCAAGTCTGGCAACACGGCCTCCCTGACCGTCTCTGGGCT<br>CCAGGCTGAGGATGAGGCTGATTATTACTGCAGCTCATATGCAGGCA<br>GCAACAGTGTCTTCGGAACTGGCACCCAGCTGACCGTCCTC |
| 85 | 1354 | 1354 | QSVLIQPASVSGSPGQSITISCTGTSSDVGGYNYVSWYQQHPGNAPKLMI<br>YEVSKRPSGVPDRFSGFKSGNTASLTVSGLQAEDEADYYCSSYAGSNSV<br>FGTGTQLTVL |
| 85 | 1355 | 1355 | TGTSSDVGGYNYVS |
| 85 | 1356 | 1356 | ACTGGAACCAGCAGTGACGTTGGTGGTTATAACTATGTCTCC |
| 85 | 1357 | 1357 | EVSKRPS |
| 85 | 1358 | 1358 | GAAGTCAGTAAGCGGCCCTCA |
| 85 | 1359 | 1359 | SSYAGSNSV |
| 85 | 1360 | 1360 | AGCTCATATGCAGGCAGCAACAGTGTC |
| 86 | 1361 | 1361 | GAGGTGCAGCTGGTGGAGTCGGGCCCAGGACTAGTTAGGCCTTCACA<br>GACCCTGTCCATAAAGTGCAGTGTCTCTGGCGGCTCCATCAATAGAG<br>GTGCTTACTTCTGGACCTGGATCCGCCAGCGCCCAGGGAAGGGCCTG<br>GAGTGGATTGGGTCCATCCATGACACCGGCAGCTACTACAACCCGTC<br>CCTCAAGACACGAGTTTCCATCTCCGGGGACACGTCTAAAAACCTCTT<br>CACCCTGGAGTTGACCTCGCTGACTGCCGCGGACACGGCCGTGTATT<br>ACTGTGCGAGGGGGCGTGGATACAGCTATGGCTGGCGTTACTTTGAC<br>TCCTGGGGCCAGGGAACCCTGGTCACCGTCTCCTCA |
| 86 | 1362 | 1362 | EVQLVESGPGLVRPSQTLSIKCSVSGGSINRGAYFWTWIRQRPGKGLEWI<br>GSIHDTGSYYNPSLKTRVSISGDTSKNLFTLELTSLTAADTAVYYCARGR<br>GYSYGWRYFDSWGQGTLVTVSS |
| 86 | 1363 | 1363 | GSINRGAYFWT |
| 86 | 1364 | 1364 | GGCTCCATCAATAGAGGTGCTTACTTCTGGACC |
| 86 | 1365 | 1365 | SIHDTGSYYNPSLKT |
| 86 | 1366 | 1366 | TCCATCCATGACACCGGCAGCTACTACAACCCGTCCCTCAAGACA |
| 86 | 1367 | 1367 | ARGRGYSYGWRYFDS |
| 86 | 1368 | 1368 | GCGAGGGGGCGTGGATACAGCTATGGCTGGCGTTACTTTGACTCC |
| 86 | 1369 | 1369 | TCCTATGTGCTGACTCAGCCACCCTCGGTGTCAGTGTCTCCAGGACAG<br>ACGGCCAGGATCACCTGCTCTGGCGATGCATTCCCAAGACAATATTCT<br>TATTGGTACCAGCAGAAGGCAGGCCAGCCCCCTGTGTTGGTAATATT<br>GAAAGACTCTGAGAGGCCCTCAGGGATCCCTGCGCGATTCTCTGGCT<br>CCACCTCAGGGACAACAGTCACCTTGACCATCACTGGAGTCCAGGCA<br>GAAGACGAGGCAGACTATTACTGTCAATCATCGGACAGCAGTGGAAA<br>TTATGTGGTGTTCGGCGGAGGGACCAAGCTCACCGTCCTA |
| 86 | 1370 | 1370 | SYVLTQPPSVSVSPGQTARITCSGDAFPRQYSYWYQQKAGQPPVLVILKD<br>SERPSGIPARFSGSTSGTTVTLTITGVQAEDEADYYCQSSDSSGNYVVFGG<br>GTKLTVL |
| 86 | 1371 | 1371 | SGDAFPRQYSY |
| 86 | 1372 | 1372 | TCTGGCGATGCATTCCCAAGACAATATTCTTAT |
| 86 | 1373 | 1373 | KDSERPS |
| 86 | 1374 | 1374 | AAAGACTCTGAGAGGCCCTCA |

TABLE 6-continued

Informal Sequence Listing

| Antibody No. | Seq. Ref. No. | SEQ ID NO. | Sequence |
|---|---|---|---|
| 86 | 1375 | 1375 | QSSDSSGNYVV |
| 86 | 1376 | 1376 | CAATCATCGGACAGCAGTGGAAATTATGTGGTG |
| 87 | 1377 | 1377 | CAGGTCCAGCTTGTGCAGTCTGGGGCTGAATTGAAGAGGCCTGGGTC<br>ATCGGTGAAGGTCTCCTGCAAGGCTTCAGGGGTCTATTTGACCTCGGT<br>TGCTGTCAACTGGGTGCGACAGGTCCCTGGACATGGGTTCGAGTGGA<br>TGGGTGGGATACTCACTGGCTTTGGTAAAGTCAGACACGCCCAGGCC<br>TTTGAGAACCGTGCCACGCTCACCGCGGACGCGTCGACCAACACAGC<br>CTACTTGGAGTTGAGCGGACTTCAAGCTGAAGACACGGCCGCCTATT<br>ATTGTGCGATAATCGACCCCCAAGATTGTACGGCCGCCAGCTGCTTTT<br>GGGTCAACTGGCTCGACCCCTGGGGCCAGGGAACCCTGGTCACCGTC<br>TCCTCA |
| 87 | 1378 | 1378 | QVQLVQSGAELKRPGSSVKVSCKASGVYLTSVAVNWVRQVPGHGFEW<br>MGGILTGFGKVRHAQAFENRATLTADASTNTAYLELSGLQAEDTAAYY<br>CAIIDPQDCTAASCFWVNWLDPWGQGTLVTVSS |
| 87 | 1379 | 1379 | VYLTSVAVN |
| 87 | 1380 | 1380 | GTCTATTTGACCTCGGTTGCTGTCAAC |
| 87 | 1381 | 1381 | GILTGFGKVRHAQAFEN |
| 87 | 1382 | 1382 | GGGATACTCACTGGCTTTGGTAAAGTCAGACACGCCCAGGCCTTTGA<br>GAAC |
| 87 | 1383 | 1383 | AIIDPQDCTAASCFWVNWLDP |
| 87 | 1384 | 1384 | GCGATAATCGACCCCCAAGATTGTACGGCCGCCAGCTGCTTTTGGGTC<br>AACTGGCTCGACCCC |
| 87 | 1385 | 1385 | GAAATTGTATTGACACAGTCTCCAGGCACCCTGACCGTGTCTCCAGG<br>GGAGAGAGCCACCCTCTCCTGCAGGGCCAGTCAGAGTGTTCTTAGTA<br>GTCACTTAGCCTGGTACCAGCAGAAACCTGGCCAGGCTCCCAGGCTC<br>CTCATCTATGCTGCATCCAGTAGGGCCACTGACGTCCCAGACAGGTTC<br>AGTGGCAGTGGGTCTGGGACAGACTTCACTCTCACCATCAGCAGACT<br>GGAGCCTCAAGATTTTGCAGTCTATTACTGTCAGCAGTATGGTTCCTC<br>TCCGATCACCTTCGGCCAAGGGACACGACTGGAGATTAAA |
| 87 | 1386 | 1386 | EIVLTQSPGTLTVSPGERATLSCRASQSVLSSHLAWYQQKPGQAPRLLIY<br>AASSRATDVPDRFSGSGSGTDFTLTISRLEPQDFAVYYCQQYGSSPITFGQ<br>GTRLEIK |
| 87 | 1387 | 1387 | RASQSVLSSHLA |
| 87 | 1388 | 1388 | AGGGCCAGTCAGAGTGTTCTTAGTAGTCACTTAGCC |
| 87 | 1389 | 1389 | AASSRAT |
| 87 | 1390 | 1390 | GCTGCATCCAGTAGGGCCACT |
| 87 | 1391 | 1391 | QQYGSSPIT |
| 87 | 1392 | 1392 | CAGCAGTATGGTTCCTCTCCGATCACC |
| 88 | 1393 | 1393 | CAGGTCCAGCTGGTGCAGTCTGGGGCTGAGGTGAAGAAGCCTGGGTC<br>CTCGGTGAAGGTCTCCTGTAAGGTTGCCGGAGGTTCCTTCTCCAATTA<br>TGCAATCGCCTGGCTGCGACAGGCCCCTGGACAAGGGCTTGAGTGGA<br>TGGGAGGGATCATACCTGCCTTTAATAGAGCAATGTATGCACGGAAG<br>TTCCAAGACAGAGTCACAATTACCGCGTACGCATCAACGACCACTGC<br>CTACCTGGACATTACCGGCCTCAGATCTGAGGACACGGCCCTTTATTA<br>TTGTGCGAGGCCTGCTGGAGACTTTGGGGATTTAAAGTGGGTACGAT<br>CGCCTTTTGACTACTGGGGCCAGGGAACCCTGGTCACCGTCTCCTCA |
| 88 | 1394 | 1394 | QVQLVQSGAEVKKPGSSVKVSCKVAGGSFSNYAIAWLRQAPGQGLEW<br>MGGIIPAFNRAMYARKFQDRVTITAYASTTTAYLDITGLRSEDTALYYCA<br>RPAGDFGDLKWVRSPFDYWGQGTLVTVSS |
| 88 | 1395 | 1395 | GSFSNYAIA |
| 88 | 1396 | 1396 | GGTTCCTTCTCCAATTATGCAATCGCC |
| 88 | 1397 | 1397 | GIIPAFNRAMYARKFQD |

TABLE 6-continued

Informal Sequence Listing

| Antibody No. | Seq. Ref. No. | SEQ ID NO. | Sequence |
|---|---|---|---|
| 88 | 1398 | 1398 | GGGATCATACCTGCCTTTAATAGAGCAATGTATGCACGGAAGTTCCAAGAC |
| 88 | 1399 | 1399 | ARPAGDFGDLKWVRSPFDY |
| 88 | 1400 | 1400 | GCGAGGCCTGCTGGAGACTTTGGGGATTTAAAGTGGGTACGATCGCCTTTTGACTAC |
| 88 | 1401 | 1401 | GAAACGACACTCACGCAGTCTCCAGGCACCCTGTCTGTGTCTCCAGGGGAAAGAGCCACCCTCTCCTGCAGGGCCAGTCAGGAAGTTGGCATCAACTTAGCCTGGTATCAGCAGAAACCTGGCCAGGCTCCCAGGCTCCTCATATATGGTGCATCCACCAGGGCCACTGATGTCCCAGCCAGGTTCAGTGGCAGTGGGTCTGGGACAGAGTTCACTCTCACCATCAGCAGCCTGCAGTCTGAAGATTTTGCAGTTTATTATTGTCAGGAGTATAATGACTGGCCTCCCCAGCTCACTTTCGGCCCTGGGACCAAAGTGGATATCAAA |
| 88 | 1402 | 1402 | ETTLTQSPGTLSVSPGERATLSCRASQEVGINLAWYQQKPGQAPRLLIYGASTRATDVPARFSGSGSGTEFTLTISSLQSEDFAVYYCQEYNDWPPQLTFGPGTKVDIK |
| 88 | 1403 | 1403 | RASQEVGINLA |
| 88 | 1404 | 1404 | AGGGCCAGTCAGGAAGTTGGCATCAACTTAGCC |
| 88 | 1405 | 1405 | GASTRAT |
| 88 | 1406 | 1406 | GGTGCATCCACCAGGGCCACT |
| 88 | 1407 | 1407 | QEYNDWPPQLT |
| 88 | 1408 | 1408 | CAGGAGTATAATGACTGGCCTCCCCAGCTCACT |
| 89 | 1409 | 1409 | GAGGTGCAGCTGGTGGAGTCTGGGGGAGGCTTGGTAAAGCCTGGGGGGTCCCTAAGACTCTCATGTGCAGCCTCTGGATTCATCTTCCGCAACGCCTGGATGAGCTGGGTCCGCCAGGCTCCAGGGAAGGGGCTGGAGTGGGTTGGCCGGATTAAAAGGACAAGTGAAGGTGGGTCAGTCGACTACGCGACACCCGTGCAAGGCAGATTCTCCATCTCAAGAGATGATTCTAGAAACACGCTGTATCTGCAAATGAACAGCCTGGAAACCGACGACACAGCCGTGTATTACTGTTCCACAGGCCCACCCTATTCTTACTTTGATAGTAGTGGTTATTCGGTCGTGGACTACTGGGGCCAGGGAACCCTGGTCACCGTCTCCTCA |
| 89 | 1410 | 1410 | EVQLVESGGGLVKPGGSLRLSCAASGFIFRNAWMSWVRQAPGKGLEWVGRIKRTSEGGSVDYATPVQGRFSISRDDSRNTLYLQMNSLETDDTAVYYCSTGPPYSYFDSSGYSVVDYWGQGTLVTVSS |
| 89 | 1411 | 1411 | FIFRNAWMS |
| 89 | 1412 | 1412 | TTCATCTTCCGCAACGCCTGGATGAGC |
| 89 | 1413 | 1413 | RIKRTSEGGSVDYATPVQG |
| 89 | 1414 | 1414 | CGGATTAAAAGGACAAGTGAAGGTGGGTCAGTCGACTACGCGACACCCGTGCAAGGC |
| 89 | 1415 | 1415 | STGPPYSYFDSSGYSVVDY |
| 89 | 1416 | 1416 | TCCACAGGCCCACCCTATTCTTACTTTGATAGTAGTGGTTATTCGGTCGTGGACTAC |
| 89 | 1417 | 1417 | CAGTCTGTCGTGACGCAGCCGCCCTCAGTGTCTGGGACCCCCGGGCAGAGGGTCACCATCTCCTGCACTGGGAGCTCCTCAACATCGGGACACCTTTTGATGTACACTGGTACCAGCAGATTCCAGAGACAGCCCCCAAACTCATCATATCTGGTGGTTTCAGTCGGCCCTCAGGGGTCCCTGACCGATTCTCTGGCTCCCAGTCTGGCACCTCTGCCTCCCTGGCCATCAGTGGGCTCCGGTCCGAGGATGAAGGTGATTATTATTGTGCAGCTTGGGATGACAGCCTGAGTGGTCCGGTGTTCGGCGGAGGGACCAAGCTCACCGTCCTA |
| 89 | 1418 | 1418 | QSVVTQPPSVSGTPGQRVTISCTGSSSNIGTPFDVHWYQQIPETAPKLIISGGFSRPSGVPDRFSGSQSGTSASLAISGLRSEDEGDYYCAAWDDSLSGPVFGGGTKLTVL |

TABLE 6-continued

Informal Sequence Listing

| Antibody No. | Seq. Ref. No. | SEQ ID NO. | Sequence |
|---|---|---|---|
| 89 | 1419 | 1419 | TGSSSNIGTPFDVH |
| 89 | 1420 | 1420 | ACTGGGAGCTCCTCCAACATCGGGACACCTTTTGATGTACAC |
| 89 | 1421 | 1421 | GGFSRPS |
| 89 | 1422 | 1422 | GGTGGTTTCAGTCGGCCCTCA |
| 89 | 1423 | 1423 | AAWDDSLSGPV |
| 89 | 1424 | 1424 | GCAGCTTGGGATGACAGCCTGAGTGGTCCGGTG |
| 90 | 1425 | 1425 | CAGGTGCAGCTGGTGCAGTCTGGGGCTGAGGTGAAGAAGCCTGGGTC<br>CTCGGTGAAGGTCTCCTGTAAGGTTGTCGGAGGCAGTTTCAGCAACT<br>ATGGGATTGGCTGGGTGCGACAGGCCCCTGGACAAGGGCCTGAGTGG<br>ATGGGAGGGATCATCCCTGCCTTTAAGACAGCAAAATATGCAAAGAA<br>GTTCCAGGACAGAGTCACAATTACCGCGGACGAATCTTCGAGCACTG<br>CCTACATGGAGGTGAGAGGCCTCAGACCTGACGACACGGCCCTGTAT<br>TATTGTGCGAGGCCTGAAGGAGACTTTGGAGATTTGAAGTGGGTACG<br>ATCGCCTTTTGACTACTGGGGCCAGGGAACCCTGGTCACCGTCTCCTCA |
| 90 | 1426 | 1426 | QVQLVQSGAEVKKPGSSVKVSCKVVGGSFSNYGIGWVRQAPGQGPEW<br>MGGIIPAFKTAKYAKKFQDRVTITADESSSTAYMEVRGLRPDDTALYYC<br>ARPEGDFGDLKWVRSPFDYWGQGTLVTVSS |
| 90 | 1427 | 1427 | GSFSNYGIG |
| 90 | 1428 | 1428 | GGCAGTTTCAGCAACTATGGGATTGGC |
| 90 | 1429 | 1429 | GIIPAFKTAKYAKKFQD |
| 90 | 1430 | 1430 | GGGATCATCCCTGCCTTTAAGACAGCAAAATATGCAAAGAAGTTCCA<br>GGAC |
| 90 | 1431 | 1431 | ARPEGDFGDLKWVRSPFDY |
| 90 | 1432 | 1432 | GCGAGGCCTGAAGGAGACTTTGGAGATTTGAAGTGGGTACGATCGCC<br>TTTTGACTAC |
| 90 | 1433 | 1433 | GAAACGACACTCACGCAGTCTCCAGCCACCCTGTCTGTGTCTCCAGG<br>GGAAAGAGTCACCCTCTCCTGCAGGGCCAGTCAGGATGTTAGCATCA<br>ACTTAGCCTGGTACCAGCAGAAACCTGGCCAGGCTCCCAGGCTCCTC<br>ATCTATGGTGCATCCACCAGGGCCACTGATGTCCCAGCCAGGTTCAGT<br>GGCAGTGGGTCTGGGACAGACTTCACTCTCACCATCAGCAGCCTGCA<br>GTCTGAAGATTTTGCATTTTATTATTGTCAGGAGTATAATGACTGGCC<br>TCCCCAGCTCACTTTCGGCCCTGGGACCAAGGTGGAAATCAAA |
| 90 | 1434 | 1434 | ETTLTQSPATLSVSPGERVTLSCRASQDVSINLAWYQQKPGQAPRLLIYG<br>ASTRATDVPARFSGSGSGTDFTLTISSLQSEDFAFYYCQEYNDWPPQLTF<br>GPGTKVEIK |
| 90 | 1435 | 1435 | RASQDVSINLA |
| 90 | 1436 | 1436 | AGGGCCAGTCAGGATGTTAGCATCAACTTAGCC |
| 90 | 1437 | 1437 | GASTRAT |
| 90 | 1438 | 1438 | GGTGCATCCACCAGGGCCACT |
| 90 | 1439 | 1439 | QEYNDWPPQLT |
| 90 | 1440 | 1440 | CAGGAGTATAATGACTGGCCTCCCCAGCTCACT |
| 91 | 1441 | 1441 | CAGGTCCAGCTGGTGCAGTCTGGGGCTGAGGTGAAGAAGCCTGGGTC<br>ATCGGTGAAGGTCTCCTGCAAGGCCTCAGGAGTCATTTTGACCAGCG<br>TTGCTGTCAGCTGGGTGCGGCAGGCCCCTGGAAAAGGCTTTGAGTGG<br>ATGGGAGGGATTCTTCCTGGCTTTAATAAAGTCAGACACGCCCAGGA<br>TTTTGAGAACAGAGCCACTCACACCGCGGACGCATCTACGAACACAG<br>TCTACATGGAGTTGAGCGACTGAAATCTGAGGACACGGCCGTCTAT<br>TACTGTGCGATAATCGACCCCCAAGATTGTACTCGTGCCAGTTGCTTT<br>TGGGTCAACTGGCTCGCCCCCTGGGGCCAGGGAACCCTGGTCACCGT<br>CTCCTCA |

TABLE 6-continued

Informal Sequence Listing

| Antibody No. | Seq. Ref. No. | SEQ ID NO. | Sequence |
|---|---|---|---|
| 91 | 1442 | 1442 | QVQLVQSGAEVKKPGSSVKVSCKASGVILTSVAVSWVRQAPGKGFEWM GGILPGFNKVRHAQDFENRATHTADASTNTVYMELSGLKSEDTAVYYC AIIDPQDCTRASCFWVNWLAPWGQGTLVTVSS |
| 91 | 1443 | 1443 | VILTSVAVS |
| 91 | 1444 | 1444 | GTCATTTTGACCAGCGTTGCTGTCAGC |
| 91 | 1445 | 1445 | GILPGFNKVRHAQDFEN |
| 91 | 1446 | 1446 | GGGATTCTTCCTGGCTTTAATAAAGTCAGACACGCCCAGGATTTTGAG AAC |
| 91 | 1447 | 1447 | AIIDPQDCTRASCFWVNWLAP |
| 91 | 1448 | 1448 | GCGATAATCGACCCCCAAGATTGTACTCGTGCCAGTTGCTTTTGGGTC AACTGGCTCGCCCCC |
| 91 | 1449 | 1449 | GAAACGACACTCACGCAGTCTCCCGGCACCCTGACCTTGTCTCCAGG GGAGAGAGCCACCCTGTCCTGCAGGGCCAGTCAGAGTGTTCCTAGCA GGAACTTAGCCTGGTACCAGCAGAAACCTGGCCAGGCTCCCAGGCTC ATCATCTATGCTGCATCCAATAGGGCCACTGACATCCCAGACAGGTTC AGTGGCAGTGGGTCTGGGACAGATTTCACTCTCACCATCAGCAGACT GGAGCCTCAAGATTTTGCAGTGTATTACTGTCAGCAGTATGAAACCTC TCCGATCACCTTCGGCCAAGGGACCAAAGTGGATATCAAA |
| 91 | 1450 | 1450 | ETTLTQSPGTLTLSPGERATLSCRASQSVPSRNLAWYQQKPGQAPRLIIYA ASNRATDIPDRFSGSGSGTDFTLTISRLEPQDFAVYYCQQYETSPITFGQG TKVDIK |
| 91 | 1451 | 1451 | RASQSVPSRNLA |
| 91 | 1452 | 1452 | AGGGCCAGTCAGAGTGTTCCTAGCAGGAACTTAGCC |
| 91 | 1453 | 1453 | AASNRAT |
| 91 | 1454 | 1454 | GCTGCATCCAATAGGGCCACT |
| 91 | 1455 | 1455 | QQYETSPIT |
| 91 | 1456 | 1456 | CAGCAGTATGAAACCTCTCCGATCACC |
| 92 | 1457 | 1457 | GAGGTGCAGCTGGTGGAGTCTGGGGGAGGCTTGGTAAAGCCTGGGGG GTCCCTAAGACTCTCATGTGCAGCCTCTGGATTCATCTTCCGCAACGC CTGGATGAGCTGGGTCCGCCAGGCTCCAGGGAAGGGGCTGGAGTGGG TTGGCCGGATTAAAAGGACAAGTGAAGGTGGGTCAGTCGACTACGCG ACACCCGTGCAAGGCAGATTCTCCATCTCAAGAGATGATTCTAGAAA GACGCTGTATCTGCAAATGAACAGCCTGGAAACCGACGACACAGCCG TGTATTACTGTTCCACAGGCCCACCCTATTCTTACTTTGATAGTAGTG GTTATTCGGTCGTGGACTACTGGGGCCTGGGAACCCTGGTCACCGTCT CCTCA |
| 92 | 1458 | 1458 | EVQLVESGGGLVKPGGSLRLSCAASGFIFRNAWMSWVRQAPGKGLEWV GRIKRTSEGGSVDYATPVQGRFSISRDDSRKTLYLQMNSLETDDTAVYY CSTGPPYSYFDSSGYSVVDYWGLGTLVTVSS |
| 92 | 1459 | 1459 | FIFRNAWMS |
| 92 | 1460 | 1460 | TTCATCTTCCGCAACGCCTGGATGAGC |
| 92 | 1461 | 1461 | RIKRTSEGGSVDYATPVQG |
| 92 | 1462 | 1462 | CGGATTAAAAGGACAAGTGAAGGTGGGTCAGTCGACTACGCGACACC CGTGCAAGGC |
| 92 | 1463 | 1463 | STGPPYSYFDSSGYSVVDY |
| 92 | 1464 | 1464 | TCCACAGGCCCACCCTATTCTTACTTTGATAGTAGTGGTTATTCGGTC GTGGACTAC |
| 92 | 1465 | 1465 | TCCTATGAGCTGACTCAGCCACCCTCAGCGTCTGGGACCCCCGGGCA GAGGGTCACCATCTCTTGTTCTGCAAGCAGCTCCAACATCGGAGATA ATTATTTCTACTGGTACCAACAACTCCCAGGAAAGGCCCCCACACTCC |

TABLE 6-continued

Informal Sequence Listing

| Antibody No. | Seq. Ref. No. | SEQ ID NO. | Sequence |
|---|---|---|---|
|  |  |  | TCATGTATGGTAGTGATCAACGGTCCTCAGGGGTCCCTGACCGATTCT CTGGCTCCCAGTCTGGCACCTCTGCCTCCCTGGCCATCAGTGGGCTCC GGTCCGAGGATGAAGCTGATTATTATTGTGCAGCTTGGGATGACAGC CTGAGTGGTCCGGTGTTCGGCGGAGGCACCCAGCTGACCGTCCTC |
| 92 | 1466 | 1466 | SYELTQPPSASGTPGQRVTISCSASSSNIGDNYFYWYQQLPGKAPTLLMY GSDQRSSGVPDRFSGSQSGTSASLAISGLRSEDEADYYCAAWDDSLSGPV FGGGTQLTVL |
| 92 | 1467 | 1467 | SASSSNIGDNYFY |
| 92 | 1468 | 1468 | TCTGCAAGCAGCTCCAACATCGGAGATAATTATTTCTAC |
| 92 | 1469 | 1469 | GSDQRSS |
| 92 | 1470 | 1470 | GGTAGTGATCAACGGTCCTCA |
| 92 | 1471 | 1471 | AAWDDSLSGPV |
| 92 | 1472 | 1472 | GCAGCTTGGGATGACAGCCTGAGTGGTCCGGTG |
| 93 | 1473 | 1473 | CAGGTCCAGCTGGTGCAGTCTGGGGCTGAGGTGAAGAAGCCTGGGTC CTCGGTGATAATCTCCTGCAAGGCATCTGGAGGCACCTTCAGAAACT ACGGTTTCACCTGGGTGCGACAGGCCCCTGGACAAGGGCTTGAGTGG TTGGGAGGGATCATCCCTATGTTTGAGACAGTCAGATATGCACAGAA GTTCCAGGGAAGAGTCACAATCACCGCGGACGAAAACACCAACACA GCCTTCCTGGCGGTGAGCAGCCTGCGATCTGAAGACACGGGCGTCTA TTTTTGTGCGCGAGACCTCCAGACGGGGATTATGAGCAGCGTGAGGT CGGAATATAGGGGCTTTATGGACCCCTGGGGCCAGGGAACCCTGGTC ACCGTCTCCTCA |
| 93 | 1474 | 1474 | QVQLVQSGAEVKKPGSSVIISCKASGGTFRNYGFTWVRQAPGQGLEWLG GIIPMFETVRYAQKFQGRVTITADENTNTAFLAVSSLRSEDTGVYFCARD LQTGIMSSVRSEYRGFMDPWGQGTLVTVSS |
| 93 | 1475 | 1475 | GTFRNYGFT |
| 93 | 1476 | 1476 | GGCACCTTCAGAAACTACGGTTTCACC |
| 93 | 1477 | 1477 | GIIPMFETVRYAQKFQG |
| 93 | 1478 | 1478 | GGGATCATCCCTATGTTTGAGACAGTCAGATATGCACAGAAGTTCCA GGGA |
| 93 | 1479 | 1479 | ARDLQTGIMSSVRSEYRGFMDP |
| 93 | 1480 | 1480 | GCGCGAGACCTCCAGACGGGGATTATGAGCAGCGTGAGGTCGGAATA TAGGGGCTTTATGGACCCC |
| 93 | 1481 | 1481 | CAGTCTGTGCTGACGCAGCCGCCCTCGGTGTCTGGAGCCCCCCGGCA GAGGGTCACCATCTCCTGTTCTGGAAGCAGCTCCAACATCGGAACTA ATGCTGTAAACTGGTACCAACAGCTCCCAGGAAAGTCTCCCAAAGTC CTCATCTACTATGATGAGCTGGTGCCCTCAGGGGTCTCTGACCGATTC TCTGGCTCCAGGTCTGGCACCTCAGCCTCCCTGGCCATAAGTGGACTC CGGTCTGAGGATGAGGCTTACTATTACTGTGCAGCTTGGGATGACAG TCTGAATGGTTGGGTGTTCGGCGGAGGCACCCAGCTCACCGTCCTA |
| 93 | 1482 | 1482 | QSVLTQPPSVSGAPRQRVTISCSGSSSNIGTNAVNWYQQLPGKSPKVLIY YDELVPSGVSDRFSGSRSGTSASLAISGLRSEDEAYYYCAAWDDSLNGW VFGGGTQLTVL |
| 93 | 1483 | 1483 | SGSSSNIGTNAVN |
| 93 | 1484 | 1484 | TCTGGAAGCAGCTCCAACATCGGAACTAATGCTGTAAAC |
| 93 | 1485 | 1485 | YDELVPS |
| 93 | 1486 | 1486 | TATGATGAGCTGGTGCCCTCA |
| 93 | 1487 | 1487 | AAWDDSLNGWV |
| 93 | 1488 | 1488 | GCAGCTTGGGATGACAGTCTGAATGGTTGGGTG |

TABLE 6-continued

Informal Sequence Listing

| Antibody No. | Seq. Ref. No. | SEQ ID NO. | Sequence |
|---|---|---|---|
| 94 | 1489 | 1489 | GAGGTGCAGCTGGTGGAGTCGGGGGGAGGCGTGGTCCAGCCTGGGA<br>GGTCCCTGAGACTCTCCTGTGCAGTCTCTGGATTCACGTTCAGTAACT<br>TTGGGATGCACTGGGTCCGCCAGGCTCCAGGCAAGGGGCTGGAGTGG<br>GTGGCAGCTATTTCATACGATGGAAGAAAAAGATTCCAGGCAGACTC<br>CGTGAAGGGCCGATTCACCATCTCCAGAGACAACTTGAAGAACACGC<br>TGAATCTCCAAATGAACAGCCTGAAAACTGAGGACACGGCTGTGTAT<br>TACTGTGCGAAATCGTCTAGACTTTTGGACTGGTTATACAATATGGAC<br>TTCTGGGGCCAAGGGACCACGGTCACCGTCTCCTCA |
| 94 | 1490 | 1490 | EVQLVESGGGVVQPGRSLRLSCAVSGFTFSNFGMHWVRQAPGKGLEWV<br>AAISYDGRKRFQADSVKGRFTISRDNLKNTLNLQMNSLKTEDTAVYYCA<br>KSSRLLDWLYNMDFWGQGTTVTVSS |
| 94 | 1491 | 1491 | FTFSNFGMH |
| 94 | 1492 | 1492 | TTCACGTTCAGTAACTTTGGGATGCAC |
| 94 | 1493 | 1493 | AISYDGRKRFQADSVKG |
| 94 | 1494 | 1494 | GCTATTTCATACGATGGAAGAAAAAGATTCCAGGCAGACTCCGTGAA<br>GGGC |
| 94 | 1495 | 1495 | AKSSRLLDWLYNMDF |
| 94 | 1496 | 1496 | GCGAAATCGTCTAGACTTTTGGACTGGTTATACAATATGGACTTC |
| 94 | 1497 | 1497 | TCCTATGTGCTGACTCAGCCACCCTCAGTGTCAGTGGCCCCAGGAAA<br>GACGGCCAGGATTACCTGTGGGGGAAACATCCTTGGGAGTTCAAGTG<br>TCCACTGGTTCCAGCAGAAGGCAGGCCAGGCCCCTGTCCTGGTCATCT<br>ATTATGATAGCGACCGGCCCTCAGGGATCCCTGAGCGATTCTCTGGCT<br>CCCATTCTGGGGACACGGCCACCCTGACCATCAGCAGGGTCGAAGTC<br>GGGGATGAGGCCGACTATTACTGTCAGGTGTGGGATAATAGTAATTC<br>CCAGGGGGTCTTCGGCGGAGGCACCCAGCTGACCGTCCTC |
| 94 | 1498 | 1498 | SYVLTQPPSVSVAPGKTARITCGGNILGSSSVHWFQQKAGQAPVLVIYYD<br>SDRPSGIPERFSGSHSGDTATLTISRVEVGDEADYYCQVWDNSNSQGVFG<br>GGTQLTVL |
| 94 | 1499 | 1499 | GGNILGSSSVH |
| 94 | 1500 | 1500 | GGGGGAAACATCCTTGGGAGTTCAAGTGTCCAC |
| 94 | 1501 | 1501 | YDSDRPS |
| 94 | 1502 | 1502 | TATGATAGCGACCGGCCCTCA |
| 94 | 1503 | 1503 | QVWDNSNSQGV |
| 94 | 1504 | 1504 | CAGGTGTGGGATAATAGTAATTCCCAGGGGGTC |
| 95 | 1505 | 1505 | CAGGTGCAGCTACAGCAGTGGGGCCCAGGACTGGTGAAGCCGTCACA<br>GACCCTGTCCCTCACCTGCAGTGTCTCTGGTGCCTCAGTCAAAATAGG<br>TTCTAATTTCTGGACGTGGATCCGCCAGCGCCCAGGGAAGGGCCTGG<br>AGTGGATTGGGGCCATCCATGACACTGGCACCACCTACTACAACCCG<br>TCCCTTGAGCCTCAAGTAATCATTTCAACTGACACGTCTCAGAACCAA<br>TTCTCCCTGAGGCTGACCTCTGTGACTGCCGCGGACACGGCCGTTTAC<br>TACTGTGCGAGGGGCGTGGATACACCTATGGATGCGTTACTTTGA<br>CTACTGGGGCCAGGGAACCCTGGTCACCGTCTCCTCA |
| 95 | 1506 | 1506 | QVQLQQWGPGLVKPSQTLSLTCSVSGASVKIGSNFWTWIRQRPGKGLE<br>WIGAIHDTGTTYYNPSLEPQVIISTDTSQNQFSLRLTSVTAADTAVYYCA<br>RGRGYTYGWRYFDYWGQGTLVTVSS |
| 95 | 1507 | 1507 | ASVKIGSNFWT |
| 95 | 1508 | 1508 | GCCTCAGTCAAAATAGGTTCTAATTTCTGGACG |
| 95 | 1509 | 1509 | AIHDTGTTYYNPSLEP |
| 95 | 1510 | 1510 | GCCATCCATGACACTGGCACCACCTACTACAACCCGTCCCTTGAGCCT |
| 95 | 1511 | 1511 | ARGRGYTYGWRYFDY |

TABLE 6-continued

Informal Sequence Listing

| Antibody No. | Seq. Ref. No. | SEQ ID NO. | Sequence |
|---|---|---|---|
| 95 | 1512 | 1512 | GCGAGGGGGCGTGGATACACCTATGGATGGCGTTACTTTGACTAC |
| 95 | 1513 | 1513 | TCCTATGTGCTGACTCAGCCACCCTCGGTGTCAGTGTCCCCAGGACAG<br>ACGGCCAGGATCACCTGCTCTGGAGATGCATTGCCAAAGCAATATGC<br>CTTTTGGTATCAGCACAAGGCAGGACAGGCCCCTGTGTTGGTCATAA<br>AAAAAGACACTGAGAGGCCCTCAGGGATCCCTGAGCGATTCTCTGGC<br>TCCATCTCAGGGACAACAGCCACTTTGATCATCAGTGGAGTCCAGGC<br>AGAAGACGAGGCTGACTATTACTGTCAATCTTCAGACAGTAGTGGTA<br>ATGTTGTCTTATTCGGCGGAGGCACCCAGCTGACCGTCCTC |
| 95 | 1514 | 1514 | SYVLTQPPSVSVSPGQTARITCSGDALPKQYAFWYQHKAGQAPVLVIKK<br>DTERPSGIPERFSGSISGTTATLIISGVQAEDEADYYCQSSDSSGNVVLFGG<br>GTQLTVL |
| 95 | 1515 | 1515 | SGDALPKQYAF |
| 95 | 1516 | 1516 | TCTGGAGATGCATTGCCAAAGCAATATGCCTTT |
| 95 | 1517 | 1517 | KDTERPS |
| 95 | 1518 | 1518 | AAAGACACTGAGAGGCCCTCA |
| 95 | 1519 | 1519 | QSSDSSGNVVL |
| 95 | 1520 | 1520 | CAATCTTCAGACAGTAGTGGTAATGTTGTCTTA |
| 96 | 1521 | 1521 | CAGGTGCAGCTGGTGCAATCTGGGGGAGGCGTGGTCCAGCCTGGGAG<br>GTCCCTGAGACTCTCCTGTGCAGCGTCTGGATTCAGCTTCAGTAGTTA<br>TGGCATGCACTGGGTCCGCCAGGCTCCAGGCAAGGGGCTGGAGTGGG<br>TGGCAGCTATATTTTATCATGAAATTAAGGACTATTATGCAGACTCCG<br>TGAACGGCCGATTCAGCATCTCCAGAGACAATTCCAAGAACACCCTG<br>TATCTGGAAATGTACAGCCTGAAGGTCGAGGACACGGCTGTGTATTA<br>TTGTGCGAGAGATAGTGGGACCCTCACAGGACTCCCGCATGATGCCT<br>TTGATATCTGGGGCCAAGGGACCACGGTCACCGTCTCCTCA |
| 96 | 1522 | 1522 | QVQLVQSGGGVVQPGRSLRLSCAASGFSFSSYGMHWVRQAPGKGLEW<br>VAAIFYHEIKDYYADSVNGRFSISRDNSKNTLYLEMYSLKVEDTAVYYC<br>ARDSGTLTGLPHDAFDIWGQGTTVTVSS |
| 96 | 1523 | 1523 | FSFSSYGMH |
| 96 | 1524 | 1524 | TTCAGCTTCAGTAGTTATGGCATGCAC |
| 96 | 1525 | 1525 | AIFYHEIKDYYADSVNG |
| 96 | 1526 | 1526 | GCTATATTTTATCATGAAATTAAGGACTATTATGCAGACTCCGTGAAC<br>GGC |
| 96 | 1527 | 1527 | ARDSGTLTGLPHDAFDI |
| 96 | 1528 | 1528 | GCGAGAGATAGTGGGACCCTCACAGGACTCCCGCATGATGCCTTTGA<br>TATC |
| 96 | 1529 | 1529 | GACATCCAGATGACCCAGTCTCCTTCCACCCTGAGTGCATCTTTAGGA<br>GGCAGAGTCACCATCACTTGCCGGGCCAGTCAGAGTGTTACTAACAG<br>GTTGGCCTGGTATCAACACAAACCAGGGAAAGCCCCTAACCTCCTGA<br>TCTATAAGGCGTCTACTTTAGAAATCGGGGTCCCATCAAGGTTCAGCG<br>GCAGTGGATCTGGGACAGAGTTCACTCTCACCATCAGCAGCCTGCAG<br>CCTGATGATTTTGCGACTTATTACTGCCAACAGTATAGTAGTTATTCG<br>TGGACGTTCGGCCAAGGGACCAAGGTGGAAATCAAA |
| 96 | 1530 | 1530 | DIQMTQSPSTLSASLGGRVTITCRASQSVTNRLAWYQHKPGKAPNLLIYK<br>ASTLEIGVPSRFSGSGSGTEFTLTISSLQPDDFATYYCQQYSSYSWTFGQG<br>TKVEIK |
| 96 | 1531 | 1531 | RASQSVTNRLA |
| 96 | 1532 | 1532 | CGGGCCAGTCAGAGTGTTACTAACAGGTTGGCC |
| 96 | 1533 | 1533 | KASTLEI |
| 96 | 1534 | 1534 | AAGGCGTCTACTTTAGAAATC |
| 96 | 1535 | 1535 | QQYSSYSWT |

TABLE 6-continued

Informal Sequence Listing

| Antibody No. | Seq. Ref. No. | SEQ ID NO. | Sequence |
|---|---|---|---|
| 96 | 1536 | 1536 | CAACAGTATAGTAGTTATTCGTGGACG |
| 97 | 1537 | 1537 | GAGGTGCAGCTGGTGGAGTCTGGGGGAGGCTTGGTAAAGCCTGGGGG GTCCCTAAGACTCTCATGTGCAGCCTCTGGATTCATCTTCCGCAACGC CTGGATGAGCTGGGTCCGCCAGGCTCCAGGGAAGGGGCTGGAGTGGG TTGGCCGGATTAAAAGGACAAGTGAAGGTGGGTCAGTCGACTACGCG ACACCCGTGCAAGGCAGATTCTCCATCTCAAGAGATGATTCTAGAAA GACGCTGTATCTGCAAATGAACAGCCTGGAAACCGACGACACAGCCG TGTATTACTGTTCCACAGGCCCACCCTATTCTTACTTTGATAGTAGTG GTTATTCGGTCGTGGACTACTGGGGCCTGGGAACCCTGGTCACCGTCT CCTCA |
| 97 | 1538 | 1538 | EVQLVESGGGLVKPGGSLRLSCAASGFIFRNAWMSWVRQAPGKGLEWV GRIKRTSEGGSVDYATPVQGRFSISRDDSRKTLYLQMNSLETDDTAVYY CSTGPPYSYFDSSGYSVVDYWGLGTLVTVSS |
| 97 | 1539 | 1539 | FIFRNAWMS |
| 97 | 1540 | 1540 | TTCATCTTCCGCAACGCCTGGATGAGC |
| 97 | 1541 | 1541 | RIKRTSEGGSVDYATPVQG |
| 97 | 1542 | 1542 | CGGATTAAAAGGACAAGTGAAGGTGGGTCAGTCGACTACGCGACACC CGTGCAAGGC |
| 97 | 1543 | 1543 | STGPPYSYFDSSGYSVVDY |
| 97 | 1544 | 1544 | TCCACAGGCCCACCCTATTCTTACTTTGATAGTAGTGGTTATTCGGTC GTGGACTAC |
| 97 | 1545 | 1545 | CAGCCAGTGCTGACTCAGCCCCCCTCAGCGTCTGGGACCCCCGGGCA GAGGGTCACCATCTCTTGTTCTGCAAGCAGCTCCAACATCGGAGATA ATTATTTCTACTGGTACCAACAACTCCCAGGAAAGGCCCCCACACTCC TCATGTATGGTAGTGATCAACGGTCCTCAGGGGTCCCTGACCGATTCT CTGGCTCCCAGTCTGGCACCTCTGCCTCCCTGGCCATCAGTGGGCTCC GGTCCGAGGATGAAGCTGATTATTATTGTGCAGCTTGGGATGACAGC CTGAGTGGTCCGGTGTTCGGCGGAGGGACCAAGCTCACCGTCCTA |
| 97 | 1546 | 1546 | QPVLTQPPSASGTPGQRVTISCSASSSNIGDNYFYWYQQLPGKAPTLLMY GSDQRSSGVPDRFSGSQSGTSASLAISGLRSEDEADYYCAAWDDSLSGPV FGGGTKLTVL |
| 97 | 1547 | 1547 | SASSSNIGDNYFY |
| 97 | 1548 | 1548 | TCTGCAAGCAGCTCCAACATCGGAGATAATTATTTCTAC |
| 97 | 1549 | 1549 | GSDQRSS |
| 97 | 1550 | 1550 | GGTAGTGATCAACGGTCCTCA |
| 97 | 1551 | 1551 | AAWDDSLSGPV |
| 97 | 1552 | 1552 | GCAGCTTGGGATGACAGCCTGAGTGGTCCGGTG |
| 98 | 1553 | 1553 | GAGGTGCAGCTGGTGGAGTCGGGGGGAGGCGTGGTCCAGCCTGGGA GGTCCCTGAGACTCTCCTGTGCAGTCTCTGGATTCACATTCAGTAACT TTGGGATGCACTGGGTCCGCCAGGCTCCAGGCAAGGGGCTGGAGTGG GTGGCAGCTATTTCATACGATGGAAGAAAAACATTCCAGGCAGACTC CGTGAAGGGCCGATTCATCATCTCCAGAGACAACTTGAAGAACACGT TGAATCTCCAAATGAACAGCCTGAAAACTGAGGACACGGCTGTGTAT TACTGTGCGAAATCGTCTAGATTTTTGGACTGGTTATACAATATGGAC TTCTGGGGCCAAGGGACCACGGTCACCGTCTCCTCA |
| 98 | 1554 | 1554 | EVQLVESGGGVVQPGRSLRLSCAVSGFTFSNFGMHWVRQAPGKGLEWV AAISYDGRKTFQADSVKGRFIISRDNLKNTLNLQMNSLKTEDTAVYYCA KSSRFLDWLYNMDFWGQGTTVTVSS |
| 98 | 1555 | 1555 | FTFSNFGMH |
| 98 | 1556 | 1556 | TTCACATTCAGTAACTTTGGGATGCAC |
| 98 | 1557 | 1557 | AISYDGRKTFQADSVKG |

TABLE 6-continued

Informal Sequence Listing

| Antibody No. | Seq. Ref. No. | SEQ ID NO. | Sequence |
|---|---|---|---|
| 98 | 1558 | 1558 | GCTATTTCATACGATGGAAGAAAAACATTCCAGGCAGACTCCGTGAA<br>GGGC |
| 98 | 1559 | 1559 | AKSSRFLDWLYNMDF |
| 98 | 1560 | 1560 | GCGAAATCGTCTAGATTTTTGGACTGGTTATACAATATGGACTTC |
| 98 | 1561 | 1561 | TCCTATGAGCTGACACAGCCACCCTCAGTGTCAGAGGCCCCAGGAAA<br>GACGGCCACGATTACCTGTGGGGGAATCATCCTTGGGACTTCAAGTG<br>TCCACTGGTTCCAGCAGAAGTCAGGCCAGGCCCCTGTCCTGGTCATCT<br>ATTATGATAGCGACCGGCCCTCAGGGATCCCTGAGCGATTCTCTGGCT<br>CCCATTCTGGGGACACGGCCACCCTGACCATCAGCAGGGTCGAAGTC<br>GGGGATGAGGCCGACTATTACTGTCAGGTGTGGGATAATAGTCATTC<br>CCAGGGGGTCTTCGGCGGAGGCACCCAGCTGACCGTCCTC |
| 98 | 1562 | 1562 | SYELTQPPSVSEAPGKTATITCGGIILGTSSVHWFQQKSGQAPVLVIYYDS<br>DRPSGIPERFSGSHSGDTATLTISRVEVGDEADYYCQVWDNSHSQGVFG<br>GGTQLTVL |
| 98 | 1563 | 1563 | GGIILGTSSVH |
| 98 | 1564 | 1564 | GGGGGAATCATCCTTGGGACTTCAAGTGTCCAC |
| 98 | 1565 | 1565 | YDSDRPS |
| 98 | 1566 | 1566 | TATGATAGCGACCGGCCCTCA |
| 98 | 1567 | 1567 | QVWDNSHSQGV |
| 98 | 1568 | 1568 | CAGGTGTGGGATAATAGTCATTCCCAGGGGGTC |
| 99 | 1569 | 1569 | CAGGTGCAGCTGGTGGAGTCTGGGGGAGGCGTGGTCCAGCCTGGGAG<br>GTCCCTGAGACTCTCCTGTGCAGCGTCTGGATTCGCCTTCCGTGTCTA<br>TGACATCCACTGGGTCCGCCAGGCTCCAGGCAAGGGGCTGGAGTGGG<br>TGGCAGTTGCCTGGTCTGATGGACGTGATGAATTCTATGCAGACTCCG<br>TGAAGGGCCGAATCACCATCTCCAGAGACAATTCAAAGAACACTGTA<br>TATCTGCAGATGAGCAGCCTGAGAGTCGCGGATACGGCTGTGTATTA<br>CTGTGCGAGAGATAGTGGGACCCTAACAGGGCTCCCTCATGATGCTT<br>TTGATGTCTGGGGCCAGGGGACCACGGTCACCGTCTCCTCA |
| 99 | 1570 | 1570 | QVQLVESGGGVVQPGRSLRLSCAASGFAFRVYDIHWVRQAPGKGLEWV<br>AVAWSDGRDEFYADSVKGRITISRDNSKNTVYLQMSSLRVADTAVYYC<br>ARDSGTLTGLPHDAFDVWGQGTTVTVSS |
| 99 | 1571 | 1571 | FAFRVYDIH |
| 99 | 1572 | 1572 | TTCGCCTTCCGTGTCTATGACATCCAC |
| 99 | 1573 | 1573 | VAWSDGRDEFYADSVKG |
| 99 | 1574 | 1574 | GTTGCCTGGTCTGATGGACGTGATGAATTCTATGCAGACTCCGTGAAG<br>GGC |
| 99 | 1575 | 1575 | ARDSGTLTGLPHDAFDV |
| 99 | 1576 | 1576 | GCGAGAGATAGTGGGACCCTAACAGGGCTCCCTCATGATGCTTTTGA<br>TGTC |
| 99 | 1577 | 1577 | GACATCCAGTTGACCCAGTCTCCTTCCACCCTGTCTGCATCTGTAGGA<br>GACAGAGTCACCATCACTTGCCGGGCCAGTCAGAGTATTACCACCAG<br>GTTGGCCTGGTATCAGCAGAAATTAGGGAAAGCCCCTAAGCTCCTGG<br>TCTATAAGGCGTCAACTTTAGAAATTGGGGTCCCCTCAAGGTTCAGCG<br>GCAGGGGATCTGGGACAGAATTCACTCTCACCATCAGCAGCCTGCAG<br>CCTGATGATTTTGCAACTTATTACTGCCATCACTACAATAGTTATTCG<br>TGGACGTTCGGCCAAGGGACCAAAGTGGATATCAAA |
| 99 | 1578 | 1578 | DIQLTQSPSTLSASVGDRVTITCRASQSITTRLAWYQQKLGKAPKLLVYK<br>ASTLEIGVPSRFSGRGSGTEFTLTISSLQPDDFATYYCHHYNSYSWTFGQG<br>TKVDIK |
| 99 | 1579 | 1579 | RASQSITTRLA |
| 99 | 1580 | 1580 | CGGGCCAGTCAGAGTATTACCACCAGGTTGGCC |

TABLE 6-continued

Informal Sequence Listing

| Antibody No. | Seq. Ref. No. | SEQ ID NO. | Sequence |
|---|---|---|---|
| 99 | 1581 | 1581 | KASTLEI |
| 99 | 1582 | 1582 | AAGGCGTCAACTTTAGAAATT |
| 99 | 1583 | 1583 | HHYNSYSWT |
| 99 | 1584 | 1584 | CATCACTACAATAGTTATTCGTGGACG |
| 100 | 1585 | 1585 | CAGGTGCAGCTGGTGGAGTCTGGGGGAGGCGTGGTCCAGCCTGGGAG<br>GTCCCTGAGACTCTCCTGTGCTGCCTCTGGATTCACTTTCACTGACTAT<br>GCTATGCACTGGGTCCGCCAGGCTCCAGGCAAGGGACTACAGTGGGT<br>GGCACTTATATCATATAACGGACGTATACAATATTACGCAGACTCCGT<br>GAAGGGCCGATTCACCATCTCCAGAGACGATTCCAAGAACACGCTGT<br>ATCTGCAGATGAACAGCCTGAGAGCTGGGACACGGCTGTCTATTAC<br>TGTGCGAGAGATGGGGATCTTGTGGCTGTCCCAGCTGCTATCGGCTTC<br>GACTCCTGGGGCCAGGGAACCCTGGTCACCGTCTCCTCA |
| 100 | 1586 | 1586 | QVQLVESGGGVVQPGRSLRLSCAASGFTFTDYAMHWVRQAPGKGLQW<br>VALISYNGRIQYYADSVKGRFTISRDDSKNTLYLQMNSLRAGDTAVYYC<br>ARDGDLVAVPAAIGFDSWGQGTLVTSS |
| 100 | 1587 | 1587 | FTFTDYAMH |
| 100 | 1588 | 1588 | TTCACTTTCACTGACTATGCTATGCAC |
| 100 | 1589 | 1589 | LISYNGRIQYYADSVKG |
| 100 | 1590 | 1590 | CTTATATCATATAACGGACGTATACAATATTACGCAGACTCCGTGAA<br>GGGC |
| 100 | 1591 | 1591 | ARDGDLVAVPAAIGFDS |
| 100 | 1592 | 1592 | GCGAGAGATGGGGATCTTGTGGCTGTCCCAGCTGCTATCGGCTTCGA<br>CTCC |
| 100 | 1593 | 1593 | GACATCCAGGTGACCCAGTCTCCAGACTCCCTGGCTGTGTCTCTGGGC<br>GAGAGGGCCACCATCAACTGCAAGTCCAGCCAGAGTGTTTTATACAC<br>CTCCAACAACAAGAACTACTTAGCTTGGTACCAGCAGAAATCGAGAC<br>AGCCTCCTAAGCTGCTCATTTACTGGGCATCTACCCGGGAATCCGGGG<br>TCCCTGAGCGATTCAGTGGCAGCGGGTCTGGGACAGATTTCACTCTCA<br>CCATCAGCAGCCTGCAGGCTGAAGATGTGGCAGTTTATTACTGTCAG<br>CAATATTCTAGTCCTCCGTACACTTTTGGCCAGGGGACCAAGGTGGA<br>GATTAAA |
| 100 | 1594 | 1594 | DIQVTQSPDSLAVSLGERATINCKSSQSVLYTSNNKNYLAWYQQKSRQP<br>PKLLIYWASTRESGVPERFSGSGSGTDFTLTISSLQAEDVAVYYCQQYSSP<br>PYTFGQGTKVEIK |
| 100 | 1595 | 1595 | KSSQSVLYTSNNKNYLA |
| 100 | 1596 | 1596 | AAGTCCAGCCAGAGTGTTTTATACACCTCCAACAACAAGAACTACTT<br>AGCT |
| 100 | 1597 | 1597 | WASTRES |
| 100 | 1598 | 1598 | TGGGCATCTACCCGGGAATCC |
| 100 | 1599 | 1599 | QQYSSPPYT |
| 100 | 1600 | 1600 | CAGCAATATTCTAGTCCTCCGTACACT |
| 101 | 1601 | 1601 | GAGGTGCAGCTGGTGGAGTCTGGGGGAGGCCTGGTCAGGCCGGGGG<br>GGTCCCTGAGACTCTCCTGCGCAGCGTCTGGATTCGCCTTCAGTAGCT<br>ATAGTTTACACTGGGTCCGCCAGGCTCCAGGGAGGGGACTGGAGTGG<br>GTCGCATCGATCAGTGCAGGTAGCAGTTTCACAGATTACGCGGCCTC<br>AGTGAGGGGCCGATTCACTATCTCCAGAAACATCGCCAACTCACTGT<br>ATCTGCAAATGAACAGGCTGAGAGCCGAGGACACGGCTGTCTATTAC<br>TGTGCGAGAGTTATCGGAGACGGGACGATTCTTGGAGTGGTTTTTGAC<br>TACTGGGGCCCGGGAACCCTGGTCACCGTCTCCTCA |
| 101 | 1602 | 1602 | EVQLVESGGGLVRPGGSLRLSCAASGFAFSSYSLHWVRQAPGRGLEWV<br>ASISAGSSFTDYAASVRGRFTISRNIANSLYLQMNRLRAEDTAVYYCARV<br>IGDGTILGVVFDYWGPGTLVTSS |

TABLE 6-continued

Informal Sequence Listing

| Antibody No. | Seq. Ref. No. | SEQ ID NO. | Sequence |
|---|---|---|---|
| 101 | 1603 | 1603 | FAFSSYSLH |
| 101 | 1604 | 1604 | TTCGCCTTCAGTAGCTATAGTTTACAC |
| 101 | 1605 | 1605 | SISAGSSFTDYAASVRG |
| 101 | 1606 | 1606 | TCGATCAGTGCAGGTAGCAGTTTCACAGATTACGCGGCCTCAGTGAGGGGC |
| 101 | 1607 | 1607 | ARVIGDGTILGVVFDY |
| 101 | 1608 | 1608 | GCGAGAGTTATCGGAGACGGGACGATTCTTGGAGTGGTTTTTGACTAC |
| 101 | 1609 | 1609 | CAGTCTGTCCTGACGCAGCCGCCCTCAGTGTCTGGGGCCCCAGGGCAGAGGGTCACCATCTCCTGCACTGGGGGCAGGTCCAACATCGGGGCCGGTTATGATGTACACTGGTACCAGCAACTTCCAGGGACAGCCCCCAAACTCCTCATCTATGGTAACATCAATCGGCCCTCAGGGGTCCCTGACCGATTCTCTGGCTCCAAGTCTGGCACCTCAGCCTCCCTGGCCATCACTGGGCTCCTGGCTGAGGATGAGGCTGATTATTACTGCCAGTCCTATGACAGCAGCCTGAGTGTGATTTTCGGCGGAGGGACCAAGCTCACCGTCCTA |
| 101 | 1610 | 1610 | QSVLTQPPSVSGAPGQRVTISCTGGRSNIGAGYDVHWYQQLPGTAPKLLIYGNINRPSGVPDRFSGSKSGTSASLAITGLLAEDEADYYCQSYDSSLSVIFGGGTKLTVL |
| 101 | 1611 | 1611 | TGGRSNIGAGYDVH |
| 101 | 1612 | 1612 | ACTGGGGGCAGGTCCAACATCGGGGCCGGTTATGATGTACAC |
| 101 | 1613 | 1613 | GNINRPS |
| 101 | 1614 | 1614 | GGTAACATCAATCGGCCCTCA |
| 101 | 1615 | 1615 | QSYDSSLSVI |
| 101 | 1616 | 1616 | CAGTCCTATGACAGCAGCCTGAGTGTGATT |
| 102 | 1617 | 1617 | CAGGTCCAGCTGGTGCAGTCTGGAGCAGAGGTGAAAAAGCCCGGGGAGTCTCTGAAGATCTCCTGTAAGGGTTCTGGATACGTCTTTAGTAGTTACTGGGTCGCCTGGGTGCGCCAGATGCCCGGGAAAGGCCTGGAGTGGATGGGGATCATCTATCCTCATGACTCTGATACCAGATACAGCCCGGCCTTCCAAGGCCAGGTCACCATTTCAGCCGATAAGTCCATCAACACCGCCTACCTGCAGTGGAGCAGCCTGAAGGCCTCGGACACCGCCATGTATTACTGCACCATTATACTAATACCAGCTCCTATACGGGCCCCTGATGGTTTTGATATCTGGGGCCAAGGGACCACGGTCACCGTCTCCTCA |
| 102 | 1618 | 1618 | QVQLVQSGAEVKKPGESLKISCKGSGYVFSSYWVAWVRQMPGKGLEWMGIIYPHDSDTRYSPAFQGQVTISADKSINTAYLQWSSLKASDTAMYYCTIILIPAPIRAPDGFDIWGQGTTVTVSS |
| 102 | 1619 | 1619 | YVFSSYWVA |
| 102 | 1620 | 1620 | TACGTCTTTAGTAGTTACTGGGTCGCC |
| 102 | 1621 | 1621 | IIYPHDSDTRYSPAFQG |
| 102 | 1622 | 1622 | ATCATCTATCCTCATGACTCTGATACCAGATACAGCCCGGCCTTCCAAGGC |
| 102 | 1623 | 1623 | TIILIPAPIRAPDGFDI |
| 102 | 1624 | 1624 | ACCATTATACTAATACCAGCTCCTATACGGGCCCCTGATGGTTTTGATATC |
| 102 | 1625 | 1625 | AATTTTATGCTGACTCAGCCCCACTCTGTGTCGGAGTCTCCGGGGAAGACGGTAACCATCTCCTGCACCGGCAGCGGTGGCACCATTGCCAGCAACTATGTGCAGTGGTACCAGCAGCGCCCGGGCAGTGTCCCCACCACTGTGATCTATGAGAATAACGAAAGACCCTCTGGGGTCCCTGATCGGTTCTCTGGCTCCATCGACAGGTCCTCCAACTCTGCCTCCCTCACCATCTCTGGACTGAAGACTGAGGACGAGGCTGACTACTACTGTCAGTCTTATGATAGCAGCTATCATGTGGTATTCGGCGGAGGGACCAAGGTCACCGTCCTA |

TABLE 6-continued

Informal Sequence Listing

| Antibody No. | Seq. Ref. No. | SEQ ID NO. | Sequence |
|---|---|---|---|
| 102 | 1626 | 1626 | NFMLTQPHSVSESPGKTVTISCTGSGGTIASNYVQWYQQRPGSVPTTVIY ENNERPSGVPDRFSGSIDRSSNSASLTISGLKTEDEADYYCQSYDSSYHVV FGGGTKVTVL |
| 102 | 1627 | 1627 | TGSGGTIASNYVQ |
| 102 | 1628 | 1628 | ACCGGCAGCGGTGGCACCATTGCCAGCAACTATGTGCAG |
| 102 | 1629 | 1629 | ENNERPS |
| 102 | 1630 | 1630 | GAGAATAACGAAAGACCCTCT |
| 102 | 1631 | 1631 | QSYDSSYHVV |
| 102 | 1632 | 1632 | CAGTCTTATGATAGCAGCTATCATGTGGTA |
| 103 | 1633 | 1633 | CAGGTGCAGCTGGTGCAGTCTGGGGCTGAGGTGAAGAAGCCTGGGTC CTCGGTGAAGGTCTCCTGCAAGGCCTCTGGAGACACGTTCAGCAGCT ATGCTATCAGCTGGGTGCGACAGGCCCCTGGACAAGGACTTGAGTGG ATGGGAGGGGTCCTCCCTATGTTAGGGACAGCAAACTACGCACAGAG GTTCCGGGGCAGAGTCACACTTACCGCGGACGGATCCACGAACACAG CCTACATGGAGATGAGCAGCCTGAGACTTGACGACACGGCCGTGTAT TACTGTGCGAGAGTGGCCGGTCTGGGAAATAGCTACGGTCGATACCC TGACCTCTGGGGCCAGGGAACCCTGGTCACCGTCTCCTCA |
| 103 | 1634 | 1634 | QVQLVQSGAEVKKPGSSVKVSCKASGDTFSSYAISWVRQAPGQGLEWM GGVLPMLGTANYAQRFRGRVTLTADGSTNTAYMEMSSLRLDDTAVYY CARVAGLGNSYGRYPDLWGQGTLVTVSS |
| 103 | 1635 | 1635 | DTFSSYAIS |
| 103 | 1636 | 1636 | GACACGTTCAGCAGCTATGCTATCAGC |
| 103 | 1637 | 1637 | GVLPMLGTANYAQRFRG |
| 103 | 1638 | 1638 | GGGGTCCTCCCTATGTTAGGGACAGCAAACTACGCACAGAGGTTCCG GGGC |
| 103 | 1639 | 1639 | ARVAGLGNSYGRYPDL |
| 103 | 1640 | 1640 | GCGAGAGTGGCCGGTCTGGGAAATAGCTACGGTCGATACCCTGACCTC |
| 103 | 1641 | 1641 | GATATTGTGATGACCCAGTCTCCATCTTCTCTGTCTGCATCTGTTGGA GACAGAGTCACCATCACTTGTCGGGCGAGTCAGGGTATTAGCAGCTC GTTAGCCTGGTATCAGCAGAAACCAGGGAAAGCCCCTGAGCTCCTGA TCTATGCTGCATCCAGTTTGCACAGTGGGGTCCCATCGAGGTTCCGGG GCAGTGGATCTGGGACAGACTTCACTCTCACTATCAGCAGCGTGCAG CCTGAAGATTTTGCAACTTACTATTGTCAACAGGCAAACAGTTTCCCG TACACTTTTGGCCAGGGGACCAAGCTGGAGATCAAA |
| 103 | 1642 | 1642 | DIVMTQSPSSLSASVGDRVTITCRASQGISSSLAWYQQKPGKAPELLIYAA SSLHSGVPSRFRGSGSGTDFTLTISSVQPEDFATYYCQQANSFPYTFGQGT KLEIK |
| 103 | 1643 | 1643 | RASQGISSSLA |
| 103 | 1644 | 1644 | CGGGCGAGTCAGGGTATTAGCAGCTCGTTAGCC |
| 103 | 1645 | 1645 | AASSLHS |
| 103 | 1646 | 1646 | GCTGCATCCAGTTTGCACAGT |
| 103 | 1647 | 1647 | QQANSFPYT |
| 103 | 1648 | 1648 | CAACAGGCAAACAGTTTCCCGTACACT |
| 104 | 1649 | 1649 | CAGGTCCAGCTTGTACAGTCTGGAGCAGAGGTGAAAAAGCCGGGGG AGTCTCTGAAGATCTCCTGTAAGGGTGCAGGATTCGGCTCTACCAACT CCTGGATCGGCTGGGTGCGCCAGATGCCCGGGAAAGGCCTGGAGTGG ATGGGGGTCATCTTTCCAGGTGACTCTGATACCAAATACAGCCCGAC CTTCCAAGGCCAGGTCACCATCTCAGTCGACAAGTCCATCAACACCG CCTACCTGCAGTGGAGCAGCCTGAAGGCCTCGGACACCGCCATCTAT |

TABLE 6-continued

Informal Sequence Listing

| Antibody No. | Seq. Ref. No. | SEQ ID NO. | Sequence |
|---|---|---|---|
| | | | TACTGTGCGAGAATGCTGGCTTCTGTTGGTTTGTCCAACTTTGACGCG TGGGGCCAGGGAACCCTGGTCACCGTCTCCTCA |
| 104 | 1650 | 1650 | QVQLVQSGAEVKKPGESLKISCKGAGFGSTNSWIGWVRQMPGKGLEW MGVIFPGDSDTKYSPTFQGQVTISVDKSINTAYLQWSSLKASDTAIYYCA RMLASVGLSNFDAWGQGTLVTVSS |
| 104 | 1651 | 1651 | FGSTNSWIG |
| 104 | 1652 | 1652 | TTCGGCTCTACCAACTCCTGGATCGGC |
| 104 | 1653 | 1653 | VIFPGDSDTKYSPTFQG |
| 104 | 1654 | 1654 | GTCATCTTTCCAGGTGACTCTGATACCAAATACAGCCCGACCTTCCAA GGC |
| 104 | 1655 | 1655 | ARMLASVGLSNFDA |
| 104 | 1656 | 1656 | GCGAGAATGCTGGCTTCTGTTGGTTTGTCCAACTTTGACGCG |
| 104 | 1657 | 1657 | CAGCCTGTGCTGACTCAGCCACCCTCAGTGTCACTGGCCCCAGGAAA GACGGCCACGATTACCTGTGGGGAAACAACATTGGAGGTAAAAGTG TGCACTGGTACCAGCAGAAGCCAGGCCAGGCCCCTGTGCTGGTCATC GATTATGATAGCGACCGGCCCTCAGGGATCCCTGAGCGATTCTCTGG CTCCAACTCTGGGAACACGGCCACCCTGACCATCAACAGGGTCGAAG CCGGGGATGAGGCCGACTACTACTGTCAGGTGTGGGATAGTATTAGT GATCATGTGTTATTCGGTGGAGGGACCAAGCTGACCGTCCTA |
| 104 | 1658 | 1658 | QPVLTQPPSVSLAPGKTATITCGGNNIGGKSVHWYQQKPGQAPVLVIDY DSDRPSGIPERFSGSNSGNTATLTINRVEAGDEADYYCQVWDSISDHVLF GGGTKLTVL |
| 104 | 1659 | 1659 | GGNNIGGKSVH |
| 104 | 1660 | 1660 | GGGGGAAACAACATTGGAGGTAAAAGTGTGCAC |
| 104 | 1661 | 1661 | YDSDRPS |
| 104 | 1662 | 1662 | TATGATAGCGACCGGCCCTCA |
| 104 | 1663 | 1663 | QVWDSISDHVL |
| 104 | 1664 | 1664 | CAGGTGTGGGATAGTATTAGTGATCATGTGTTA |
| 105 | 1665 | 1665 | GAGGTGCAGCTGGTGGAGTCTGGGGGAGGCTTGGTTAAGCCTGGGGG GTCCCTTAGACTCTCTTGTGCAGCCTCTGGATTCACTTTCAGTAACGC CTGGATGAGCTGGGTCCGCCAGGCTCCAGGGAAGGGGCTGGAGTGGG TTGGCCGTGTTAAAAGCAAATCTAAAGGTGGGACAACACACTACGCT GAAGCCGTGAAGGGCAGATTCACCATTTCAAGAGATGATTCAAAAAA CACGCTGTACCTCCAAATGCAGAGCCTGAAAACCGAGGACACAGCCG TCTATTACTGTACCTCCCACGCGTATAATAGTGACTGGTTCGTGACGA CTGACTACTACTACATGGACGTCTGGGGCAAAGGGACCACGGTC ACCGTCTCCTCA |
| 105 | 1666 | 1666 | EVQLVESGGGLVKPGGSLRLSCAASGFTFSNAWMSWVRQAPGKGLEW VGRVKSKSKGGTTHYAEAVKGRFTISRDDSKNTLYLQMQSLKTEDTAV YYCTSHAYNSDWFVTTDYYYMDVWGKGTTVTVSS |
| 105 | 1667 | 1667 | FTFSNAWMS |
| 105 | 1668 | 1668 | TTCACTTTCAGTAACGCCTGGATGAGC |
| 105 | 1669 | 1669 | RVKSKSKGGTTHYAEAVKG |
| 105 | 1670 | 1670 | CGTGTTAAAAGCAAATCTAAAGGTGGGACAACACACTACGCTGAAGC CGTGAAGGGC |
| 105 | 1671 | 1671 | TSHAYNSDWFVTTDYYYMDV |
| 105 | 1672 | 1672 | ACCTCCCACGCGTATAATAGTGACTGGTTCGTGACGACTGACTACTAC TACTACATGGACGTC |
| 105 | 1673 | 1673 | GATATTGTGCTGACCCAGTCTCCATCCTCCCTGTCTGCATCTGTTGGA GACAGAGTCACCTTCACTTGCCGGGCAAGTCAGAGCATTAGCAACTA |

TABLE 6-continued

Informal Sequence Listing

| Antibody No. | Seq. Ref. No. | SEQ ID NO. | Sequence |
|---|---|---|---|
| | | | TTTGAATTGGTATCAGCAGAAACCAGGGAAAGCCCCTAAGGTCCTGA<br>TCTATGGTGCCTTCCAATTTGCTAAGTGGGGTCCCATCAAGGTTCATTG<br>GCAGCGGATCTGGGACAGATTTCACTCTCACCATCAACAGTCTGCAA<br>CCTGAAGATTTTGCAACTTACTACTGTCAACAGTGTTACAGTGCCCCG<br>ATCACCTTCGGCCAAGGGACACGACTGGAGATTAAA |
| 105 | 1674 | 1674 | DIVLTQSPSSLSASVGDRVTFTCRASQSISNYLNWYQQKPGKAPKVLIYG<br>ASNLLSGVPSRFIGSGSGTDFTLTINSLQPEDFATYYCQQCYSAPITFGQG<br>TRLEIK |
| 105 | 1675 | 1675 | RASQSISNYLN |
| 105 | 1676 | 1676 | CGGGCAAGTCAGAGCATTAGCAACTATTTGAAT |
| 105 | 1677 | 1677 | GASNLLS |
| 105 | 1678 | 1678 | GGTGCTTCCAATTTGCTAAGT |
| 105 | 1679 | 1679 | QQCYSAPIT |
| 105 | 1680 | 1680 | CAACAGTGTTACAGTGCCCCGATCACC |
| 106 | 1681 | 1681 | CAGGTCCAGCTGGTGCAGTCTGGGGCTGAGGTGAAGAAGCCTGGGTC<br>CTCGGTGAAGGTCTCCTGCACGGCCTCTGGAGGCAGCTTCAGCACCA<br>ATAGTATTGCCTGGCTGAGGCAGACCCCTAGAGAAGGGCTGGAGTGG<br>ATGGGAGGAATCATCCCTGTCTTTGGTGCAGCAAAATACGCACAGAA<br>GTTCCAGGGCAGAGTCACGATTAGCGCGGACGCATCCACGACCACAG<br>CCTACTTGGAGCTGCACAACCTGAGATCTGAGGACACTGCCGTCTATT<br>ACTGCGCGAGAGGAATTTCCCCCAGGACAAACAGTGACTGGAACCAC<br>AACTACTTCTACTACTACATGGACGTCTGGGGCAAAGGGACCACGGT<br>CACCGTCTCCTCA |
| 106 | 1682 | 1682 | QVQLVQSGAEVKKPGSSVKVSCTASGGSFSTNSIAWLRQTPREGLEWMG<br>GIIPVFGAAKYAQKFQGRVTISADASTTTAYLELHNLRSEDTAVYYCARG<br>ISPRTNSDWNHNYFYYYMDVWGKGTTVTVSS |
| 106 | 1683 | 1683 | GSFSTNSIA |
| 106 | 1684 | 1684 | GGCAGCTTCAGCACCAATAGTATTGCC |
| 106 | 1685 | 1685 | GIIPVFGAAKYAQKFQG |
| 106 | 1686 | 1686 | GGAATCATCCCTGTCTTTGGTGCAGCAAAATACGCACAGAAGTTCCA<br>GGGC |
| 106 | 1687 | 1687 | ARGISPRTNSDWNHNYFYYYMDV |
| 106 | 1688 | 1688 | GCGAGAGGAATTTCCCCCAGGACAAACAGTGACTGGAACCACAACTA<br>CTTCTACTACTACATGGACGTC |
| 106 | 1689 | 1689 | GAAACGACACTCACGCAGTCTCCAGGCACCCTGTCTTTGTCTCCAGGG<br>GAGAGAGCCACCCTCTCCTGCCGGGCCAGTCAGAGTATTTTCACCATC<br>TACTTAGCCTGGTACCAGCAGAAACCTGGCCAGGCTCCCAGACTCCT<br>CATCTATAGTGCATCCAACAGGGCCACTGGCATCCCAGACAGGTTCA<br>GTGGCAGTGGGTCTGGGACAGACTTCACTCTCACCATCAGCAGCCTG<br>GAGCCTGAAGATTTTGCAGTCTATTACTGCCACCACTATGGTACCTCA<br>CCTCACACTTTTGGCCAGGGGACACGACTGGAGATTAAA |
| 106 | 1690 | 1690 | ETTLTQSPGTLSLSPGERATLSCRASQSIFTIYLAWYQQKPGQAPRLLIYS<br>ASNRATGIPDRFSGSGSGTDFTLTISSLEPEDFAVYYCHHYGTSPHTFGQG<br>TRLEIK |
| 106 | 1691 | 1691 | RASQSIFTIYLA |
| 106 | 1692 | 1692 | CGGGCCAGTCAGAGTATTTTCACCATCTACTTAGCC |
| 106 | 1693 | 1693 | SASNRAT |
| 106 | 1694 | 1694 | AGTGCATCCAACAGGGCCACT |
| 106 | 1695 | 1695 | HHYGTSPHT |
| 106 | 1696 | 1696 | CACCACTATGGTACCTCACCTCACACT |

TABLE 6-continued

Informal Sequence Listing

| Antibody No. | Seq. Ref. No. | SEQ ID NO. | Sequence |
|---|---|---|---|
| 107 | 1697 | 1697 | GAGGTGCAGCTGTTGGAGTCTGGTCCTGTGCTGGTGAAACCCACAGA GACCCTCACGCTGACCTGCACCGTCTCTGGGTTCTCACTCGCCAATCC TGACGTGGCTGTGGCCTGGATCCGTCAGCCCCCCGGGAAGGCCCTGG AGTGGCTTGCACACATTTTTTCGGGCGACGAAACATCCTACACCACAT CTCTGCAGAACAGACTCACCATCTCCAAGGACACCTCCAAAAGCCAG GTTGTCCTTATCATGACCAAGATGGACCCTCGAGACACCGGCACATA TTTCTGTGCACGGGTGTTGACTACCTGGCACGGACCGGACTACTGGG GCCAGGGGACCACGGTCACCGTCTCCTCA |
| 107 | 1698 | 1698 | EVQLLESGPVLVKPTETLTLTCTVSGFSLANPDVAVAWIRQPPGKALEW LAHIFSGDETSYTTSLQNRLTISKDTSKSQVVLIMTKMDPRDTGTYFCAR VLTTWHGPDYWGQGTTVTVSS |
| 107 | 1699 | 1699 | FSLANPDVAVA |
| 107 | 1700 | 1700 | TTCTCACTCGCCAATCCTGACGTGGCTGTGGCC |
| 107 | 1701 | 1701 | HIFSGDETSYTTSLQN |
| 107 | 1702 | 1702 | CACATTTTTTCGGGCGACGAAACATCCTACACCACATCTCTGCAGAAC |
| 107 | 1703 | 1703 | ARVLTTWHGPDY |
| 107 | 1704 | 1704 | GCACGGGTGTTGACTACCTGGCACGGACCGGACTAC |
| 107 | 1705 | 1705 | GAAACGACACTCACGCAGTCTCCACTCTCCCTGCCCGTCACCCTTGGA CAGCCGGCCTCCATCTCCTGCAGGTCTGATCAAAGCCTCGTATATCAT AATGGAAACACCTACGTGAGTTGGTTTCATCAGAGGCCAGGCCAATC TCCAAGGCGCCTAATTTATAAGGTTTCTATCCGGGACTCTGGGGTCCC AGACAGATTCAGCGGCAGTGGGTCAGGCACTGATTTCGCACTGAAAA TCAGCAGGGTGGAGGCTGAGGATCTTGGGGTTTATTACTGCATGCAA GGTTCACACTGGCCGCACACTTTTGGCCAGGGGACCAAAGTGGATAT CAAA |
| 107 | 1706 | 1706 | ETTLTQSPLSLPVTLGQPASISCRSDQSLVYHNGNTYVSWFHQRPGQSPR RLIYKVSIRDSGVPDRFSGSGSGTDFALKISRVEAEDLGVYYCMQGSHWP HTFGQGTKVDIK |
| 107 | 1707 | 1707 | RSDQSLVYHNGNTYVS |
| 107 | 1708 | 1708 | AGGTCTGATCAAAGCCTCGTATATCATAATGGAAACACCTACGTGAGT |
| 107 | 1709 | 1709 | KVSIRDS |
| 107 | 1710 | 1710 | AAGGTTTCTATCCGGGACTCT |
| 107 | 1711 | 1711 | MQGSHWPHT |
| 107 | 1712 | 1712 | ATGCAAGGTTCACACTGGCCGCACACT |
| 108 | 1713 | 1713 | GAGGTGCAGCTGGTGGAGTCTGGGGGAGGCTTGGTCCAGCCTGGGGG GTCCCTGAGACTCTCCTGTGCAGCCTCTGGATTCTCGTTTAGTACCTCT TGGATGAGTTGGGTCCGCCAGGCTCCAGGGAAAGGTCTGGAGTGGCT GGCCAACATAAAGGAAGATGGAAGTAAGAAAATCTATGTGGACTCTG TGAAGGGCCGCTTCTCCATATCCAGGGACAACGCCAAGAACTCACTG TATCTGCAAATGACCAGCCTAAGAGCCGAGGACACGGCCGTGTATTA TTGTGCGAGAGATGTGTGGGGGTGGGAGCTAGTCGGATGGTTGGACC CCTGGGGCCAGGGAACCCTGGTCACCGTCTCCTCA |
| 108 | 1714 | 1714 | EVQLVESGGGLVQPGGSLRLSCAASGFSFSTSWMSWVRQAPGKGLEWL ANIKEDGSKKIYVDSVKGRFSISRDNAKNSLYLQMTSLRAEDTAVYYCA RDVWGWELVGWLDPWGQGTLVTVSS |
| 108 | 1715 | 1715 | FSFSTSWMS |
| 108 | 1716 | 1716 | TTCTCGTTTAGTACCTCTTGGATGAGT |
| 108 | 1717 | 1717 | NIKEDGSKKIYVDSVKG |
| 108 | 1718 | 1718 | AACATAAAGGAAGATGGAAGTAAGAAAATCTATGTGGACTCTGTGAA GGGC |
| 108 | 1719 | 1719 | ARDVWGWELVGWLDP |

TABLE 6-continued

Informal Sequence Listing

| Antibody No. | Seq. Ref. No. | SEQ ID NO. | Sequence |
|---|---|---|---|
| 108 | 1720 | 1720 | GCGAGAGATGTGTGGGGGTGGGAGCTAGTCGGATGGTTGGACCCC |
| 108 | 1721 | 1721 | TCCTATGAGCTGACACAGCCACCCTCGGTATCAGTGGCCCCAGGAAA GACGGCCAGCATTACCTGTGGGGGAAGCAACATTGGAAGTAGAAGTG TGCACTGGTACCAGCAGAAGCCAGGCCAGGCCCCTGTGCTGGTCGTC TATGAGGATCACGACCGGCCCTCAGGGATCCCTGAGCGATTCTCTGG CTCCAACTCTGGGAATACGGCCACCCTGACCATCAGCAGGGTCGAAG CCGGGGACGAGGCCGACTATTACTGTCAGGTGTGGGATAGTAGTAGA GATCATGTGGTATTCGGCGGCGGGACCAAGGTCACCGTCCTA |
| 108 | 1722 | 1722 | SYELTQPPSVSVAPGKTASITCGGSNIGSRSVHWYQQKPGQAPVLVVYE DHDRPSGIPERFSGSNSGNTATLTISRVEAGDEADYYCQVWDSSRDHVV FGGGTKVTVL |
| 108 | 1723 | 1723 | GGSNIGSRSVH |
| 108 | 1724 | 1724 | GGGGGAAGCAACATTGGAAGTAGAAGTGTGCAC |
| 108 | 1725 | 1725 | EDHDRPS |
| 108 | 1726 | 1726 | GAGGATCACGACCGGCCCTCA |
| 108 | 1727 | 1727 | QVWDSSRDHVV |
| 108 | 1728 | 1728 | CAGGTGTGGGATAGTAGTAGAGATCATGTGGTA |
| 109 | 1729 | 1729 | GAGGTGCAGCTGGTGGAGTCTGGTCCTGCGCTGGTGAAACCCACACA GACCCTCACACTGACCTGCACCTTCTCTGGGTTCTCACTCAGCAGTAG AAGAATGTGTGTGAGTTGGATCCGTCAGCCCCCAGGGAAGGCCCTGG AGTGGCTTGCACGCATTGATTGGGATGATGATAAATCCTACAGCACA TCTCTGAAGACCAGGCTCACCATCGCCAAGGACACCTCCAAAAACCA GGTCGTCCTTACAATGACCAACATGGGCCCCGCGGACACAGCCACGT ATTACTGTGCACGGACTCCTATATATGATAGTAGTGGTTATTACCTCT ACTACTTTGACTCCTGGGGCCAGGGAACCCTGGTCACCGTCTCCTCA |
| 109 | 1730 | 1730 | EVQLVESGPALVKPTQTLTLTCTFSGFSLSSRRMCVSWIRQPPGKALEWL ARIDWDDDKSYSTSLKTRLTIAKDTSKNQVVLTMTNMGPADTATYYCA RTPIYDSSGYYLYYFDSWGQGTLVTVSS |
| 109 | 1731 | 1731 | FSLSSRRMCVS |
| 109 | 1732 | 1732 | TTCTCACTCAGCAGTAGAAGAATGTGTGTGAGT |
| 109 | 1733 | 1733 | RIDWDDDKSYSTSLKT |
| 109 | 1734 | 1734 | CGCATTGATTGGGATGATGATAAATCCTACAGCACATCTCTGAAGACC |
| 109 | 1735 | 1735 | ARTPIYDSSGYYLYYFDS |
| 109 | 1736 | 1736 | GCACGGACTCCTATATATGATAGTAGTGGTTATTACCTCTACTACTTT GACTCC |
| 109 | 1737 | 1737 | GAAACGACACTCACGCAGTCTCCATCCTCCCTGTCTGCATCTGTCGGA GACAGAGTCACCATCACTTGCCGGGCAAGTCAGAGCATTAGCAGCTA TTTAAATTGGTATCAGCAGAAACCAGGGAAAGCCCCTAAGCTCCTGA TCTATGCTGCATCCAGTTTGCAAAGTGGGGTCCCATCAAGGTTCAGTG GCAGTGGATCTGGGACAGATTTCACTCTCACCATCAGCAGTCTGCAA CCTGAAGATTTTGCAACTTACTACTGTCAACAGAGTTACAGTACCCCT GTGACTTTTGGCCAGGGGACCAAGGTGGAGATCAAA |
| 109 | 1738 | 1738 | ETTLTQSPSSLSASVGDRVTITCRASQSISSYLNWYQQKPGKAPKLLIYAA SSLQSGVPSRFSGSGSGTDFTLTISSLQPEDFATYYCQQSYSTPVTFGQGT KVEIK |
| 109 | 1739 | 1739 | RASQSISSYLN |
| 109 | 1740 | 1740 | CGGGCAAGTCAGAGCATTAGCAGCTATTTAAAT |
| 109 | 1741 | 1741 | AASSLQS |
| 109 | 1742 | 1742 | GCTGCATCCAGTTTGCAAAGT |
| 109 | 1743 | 1743 | QQSYSTPVT |

TABLE 6-continued

Informal Sequence Listing

| Antibody No. | Seq. Ref. No. | SEQ ID NO. | Sequence |
|---|---|---|---|
| 109 | 1744 | 1744 | CAACAGAGTTACAGTACCCCTGTGACT |
| 110 | 1745 | 1745 | CAGGTCCAGCTTGTGCAGTCTGGGGGAGGCGTGGTCCAGCCTGGGAGGTCCCTGAGACTCTCCTGTGCAGCCTCTGGATTCACCTTCAGTGACTATGCTATGCACTGGGTCCGCCAGGCTCCAGGCAAGGGCCTCCAGTGGGTGTCACTTATATCATATAATGGACGTAAAAAATATTACGCAGACTCCGTGAAGGGCCGATTCACCATCTCCAGAGACGATTCCAAGAACACGCTGTATCTGCAAATGAACCCCCTGAGACCTGACGACACGGCTGTCTATTACTGTGCGAGAGATGGGGATATTGTAGCTGTTCCAGCTGCTATCGGGTTGGACTACTGGGGCCAGGGAACCCTGGTCACCGTCTCCTCA |
| 110 | 1746 | 1746 | QVQLVQSGGGVVQPGRSLRLSCAASGFTFSDYAMHWVRQAPGKGLQWVSLISYNGRKKYYADSVKGRFTISRDDSKNTLYLQMNPLRPDDTAVYYCARDGDIVAVPAAIGLDYWGQGTLVTVSS |
| 110 | 1747 | 1747 | FTFSDYAMH |
| 110 | 1748 | 1748 | TTCACCTTCAGTGACTATGCTATGCAC |
| 110 | 1749 | 1749 | LISYNGRKKYYADSVKG |
| 110 | 1750 | 1750 | CTTATATCATATAATGGACGTAAAAAATATTACGCAGACTCCGTGAAGGGC |
| 110 | 1751 | 1751 | ARDGDIVAVPAAIGLDY |
| 110 | 1752 | 1752 | GCGAGAGATGGGGATATTGTAGCTGTTCCAGCTGCTATCGGGTTGGACTAC |
| 110 | 1753 | 1753 | GATATTGTGCTGACCCAGTCTCCAGAGTCCCTGGCTGTGTCTCTGGGCGAGAGGGCCACCATCAACTGCAACTCCAGCCAGAGTGTTTTATACACCTCCAACAACAAGAACTACTTAGCTTGGTACCAGCAGAAATCAGGACAGCCTCCTAAGCTGCTCATTTACTGGGCATCTACCCGGGAATCCGGGGTCCCTGAGCGATTCAGTGGCAGCGGGTCTGGGACAGATTTCACTCTCACCATCAGCAGCCTGCAGGCTGAAGATGTGGCAGTTTATTACTGTCAGCAATATTCTAGTCCTCCGTACACTTTTGGCCAGGGGACCAAGCTGGAGATCAAA |
| 110 | 1754 | 1754 | DIVLTQSPESLAVSLGERATINCNSSQSVLYTSNNKNYLAWYQQKSGQPPKLLIYWASTRESGVPERFSGSGSGTDFTLTISSLQAEDVAVYYCQQYSSPPYTFGQGTKLEIK |
| 110 | 1755 | 1755 | NSSQSVLYTSNNKNYLA |
| 110 | 1756 | 1756 | AACTCCAGCCAGAGTGTTTTATACACCTCCAACAACAAGAACTACTTAGCT |
| 110 | 1757 | 1757 | WASTRES |
| 110 | 1758 | 1758 | TGGGCATCTACCCGGGAATCC |
| 110 | 1759 | 1759 | QQYSSPPYT |
| 110 | 1760 | 1760 | CAGCAATATTCTAGTCCTCCGTACACT |
| 111 | 1761 | 1761 | CAGGTGCAGCTGCAGGAGTCCGGCCCAGGACTAGTGAAGCCTTCAGAGACCCTGTCCCTCACTTGCAGTGTCTCTGGTGGCTCCATCAAAAGAGGTGCTTACTTCTGGACCTGGATCCGCCAGCGGCCAGGGAAGGGCCTGGAGTGGATTGGGTCCATGCATGACAGCGGCGACTACTACAACCCGTCCCTCAAGACACGCGTTACCATTTTGGGAGACACGACTAAGAACCACTTCACCCTGAAGTTGACCTCCGTGACTGTCGCGGACACGGCCTTATATTACTGTGCGAGGGGCGCGGATACAGCTATGGCTGGCGTTTCTTTGACAACTGGGGCCAGGGAACCCTGGTCACCGTCTCCTCA |
| 111 | 1762 | 1762 | QVQLQESGPGLVKPSETLSLTCSVSGGSIKRGAYFWTWIRQRPGKGLEWIGSMHDSGDYYNPSLKTRVTILGDTTKNHFTLKLTSVTVADTALYYCARGRGYSYGWRFFDNWGQGTLVTVSS |
| 111 | 1763 | 1763 | GSIKRGAYFWT |
| 111 | 1764 | 1764 | GGCTCCATCAAAAGAGGTGCTTACTTCTGGACC |
| 111 | 1765 | 1765 | SMHDSGDYYNPSLKT |

TABLE 6-continued

Informal Sequence Listing

| Antibody No. | Seq. Ref. No. | SEQ ID NO. | Sequence |
|---|---|---|---|
| 111 | 1766 | 1766 | TCCATGCATGACAGCGGCGACTACTACAACCCGTCCCTCAAGACA |
| 111 | 1767 | 1767 | ARGRGYSYGWRFFDN |
| 111 | 1768 | 1768 | GCGAGGGGGCGCGGATACAGCTATGGCTGGCGTTTCTTTGACAAC |
| 111 | 1769 | 1769 | AATTTTATGCTGACTCAGCCCCCCTCGGTGTCAGTGTCCCCAGGACAC<br>TCGACCAGGATCACCTGCTCTGGAGATGCTTTGCCAAAGCAATATGCT<br>TATTGGTATCAGCAGAAGCCAGGCCAGGCCCCTGTCCTGATAATGTC<br>CAAAGACAGTGAGAGGCCCTCAGGGATCCCTGAGCGATTCACTGGCT<br>CCAGCTCAGGGACTACAGTCACTTTGACCATCAGTGGAGTCCAGGCA<br>GAGGACGAGGCCGACTATTACTGTCAATCAGGAGACACCAGTGGAAG<br>TTATGTCGTCTTCGGCGGAGGGACCAAGGTCACCGTCCTA |
| 111 | 1770 | 1770 | NFMLTQPPSVSVSPGHSTRITCSGDALPKQYAYWYQQKPGQAPVLIMSK<br>DSERPSGIPERFTGSSSGTTVTLTISGVQAEDEADYYCQSGDTSGSYVVFG<br>GGTKVTVL |
| 111 | 1771 | 1771 | SGDALPKQYAY |
| 111 | 1772 | 1772 | TCTGGAGATGCTTTGCCAAAGCAATATGCTTAT |
| 111 | 1773 | 1773 | KDSERPS |
| 111 | 1774 | 1774 | AAAGACAGTGAGAGGCCCTCA |
| 111 | 1775 | 1775 | QSGDTSGSYVV |
| 111 | 1776 | 1776 | CAATCAGGAGACACCAGTGGAAGTTATGTCGTC |
| 112 | 1777 | 1777 | GAGGTGCAGCTGTTGGAGTCCGGGCCAGAGTTGAAGAAGCCTGGGTC<br>CTCGGTGAAGGTGTCTTGCAAGGCCTCTGCAGACACTTTCAATGGTCA<br>CTCAATTGCTTGGGTGCGGCAGGCCCCTGGACAAGGGCTTGAGTGGG<br>TGGGAGGATTCATCCCCATTTTTGGGAAAGCATACTACGCACAGAAC<br>TTCCAGGGCACAGTCACGATTTCCGCGGATTCTTCCACGAGAACAGTC<br>TACATGGATCTGTTCAACCTGAGATCTGAGGACACGGCCGTCTATTAC<br>TGTGCGAGATCAAGGAAAAATGTTATCGGGGACACCAGTGCCTGGGA<br>ACATATGTACTTCTACATGGACGTCTGGGGCACCGGGACCACGGTCA<br>CCGTCTCCTCA |
| 112 | 1778 | 1778 | EVQLLESGPELKKPGSSVKVSCKASDTFNGHSIAWVRQAPGQGLEWV<br>GGFIPIFGKAYYAQNFQGTVTISADSSTRTVYMDLFNLRSEDTAVYYCAR<br>SRKNVIGDTSAWEHMYFYMDVWGTGTTVTVSS |
| 112 | 1779 | 1779 | DTFNGHSIA |
| 112 | 1780 | 1780 | GACACTTTCAATGGTCACTCAATTGCT |
| 112 | 1781 | 1781 | GFIPIFGKAYYAQNFQG |
| 112 | 1782 | 1782 | GGATTCATCCCCATTTTTGGGAAAGCATACTACGCACAGAACTTCCAG<br>GGC |
| 112 | 1783 | 1783 | ARSRKNVIGDTSAWEHMYFYMDV |
| 112 | 1784 | 1784 | GCGAGATCAAGGAAAAATGTTATCGGGGACACCAGTGCCTGGGAAC<br>ATATGTACTTCTACATGGACGTC |
| 112 | 1785 | 1785 | GAAATTGTATTGACGCAGTCTCCAGGCACCCTGTCTTTGTCTCCAGGG<br>GAAAGAGTCACTCTCTCCTGCAGGGCCAGTGAGAGTATTAATAAGAA<br>TACCTACTTAGCCTGGTACCAACAGAAACCTGGCCAGGCTCCCAGGC<br>TCCTCATTTATGGAGCATCCAGCAGGGCCACTGGCATCCCAGACAGG<br>TTCAGTGGCAGTGGGTCTGGGACAGACTTCACTCTCACCATCAGCAG<br>ACTGGAGCCTGAAGATTCTGCTGTGTATTACTGTCAGCAATATGGTAG<br>GTCAATGACTTTCGGCGGAGGGACCAAGGTGGAAATCAAA |
| 112 | 1786 | 1786 | EIVLTQSPGTLSLSPGERVTLSCRASESINKNTYLAWYQQKPGQAPRLLIY<br>GASSRATGIPDRFSGSGSGTDFTLTISRLEPEDSAVYYCQQYGRSMTFGG<br>GTKVEIK |
| 112 | 1787 | 1787 | RASESINKNTYLA |
| 112 | 1788 | 1788 | AGGGCCAGTGAGAGTATTAATAAGAATACCTACTTAGCC |

TABLE 6-continued

Informal Sequence Listing

| Antibody No. | Seq. Ref. No. | SEQ ID NO. | Sequence |
|---|---|---|---|
| 112 | 1789 | 1789 | GASSRAT |
| 112 | 1790 | 1790 | GGAGCATCCAGCAGGGCCACT |
| 112 | 1791 | 1791 | QQYGRSMT |
| 112 | 1792 | 1792 | CAGCAATATGGTAGGTCAATGACT |
| 113 | 1793 | 1793 | CAGGTCCAGCTTGTACAGTCTGGGACTGAGGTGAAGAAGCCTGGGTCCTCGGTGAATGTCTCCTGCAAGGCTGTTGGAGGCAAGTTCACCAGTTATAATATTAACTGGGTGCGACAGGCCCCTGGACAAGGCCTTGAGTGGATGGGAAGGATCATCCCAACCCTTGGTATAACATACTTCGCACAGAAGTTCCAGGGCAGACTCACGATTAACGCGGACAGATCCACGAGCACCGCCTACATGGATCTGAGCAGCCTGAGATCTGACGATACGGCCGTTTATTATTGTGCGAGATCCAATCCCGTTGCTCGCGATTTTTGGAGTGGATATTCTGACGACTCCTCCTATGCTATGGACGTCTGGGGCCAAGGGACCACGGTCACCGTCTCCTCA |
| 113 | 1794 | 1794 | QVQLVQSGTEVKKPGSSVNVSCKAVGGKFTSYNINWVRQAPGQGLEWMGRIIPTLGITYFAQKFQGRLTINADRSTSTAYMDLSSLRSDDTAVYYCARSNPVARDFWSGYSDDSSYAMDVWGQGTTVTVSS |
| 113 | 1795 | 1795 | GKFTSYNIN |
| 113 | 1796 | 1796 | GGCAAGTTCACCAGTTATAATATTAAC |
| 113 | 1797 | 1797 | RIIPTLGITYFAQKFQG |
| 113 | 1798 | 1798 | AGGATCATCCCAACCCTTGGTATAACATACTTCGCACAGAAGTTCCAGGGC |
| 113 | 1799 | 1799 | ARSNPVARDFWSGYSDDSSYAMDV |
| 113 | 1800 | 1800 | GCGAGATCCAATCCCGTTGCTCGCGATTTTTGGAGTGGATATTCTGACGACTCCTCCTATGCTATGGACGTC |
| 113 | 1801 | 1801 | GAAACGACACTCACGCAGTCTCCAGGAACCCTGTCTTTGTCTCCAGGGGACAGAGTCAGCCTCTCCTGCAGGGCCAGTCAGACTGTTGACAAGAACTACGTAGCCTGGTACCAGCAGAAGCCTGGCCAGGCTCCCAGGCTCCTCATCTATGGTGCATCCAAGAGGGCCGCTGACATCCCAGACAGGTTCAGTGGCAGTGGCTCTGGGGCAGACTTCACTCTCACCATCAGCAGACTGGAGCCTGAAGATTTTGCTGTGTATCACTGTCAGCAGTATGGAGCTTCAGCGTTCAGTTTCGGCGGCGGGACCAAGCTGGAGATCAAA |
| 113 | 1802 | 1802 | ETTLTQSPGTLSLSPGDRVSLSCRASQTVDKNYVAWYQQKPGQAPRLLIYGASKRAADIPDRFSGSGSGADFTLTISRLEPEDFAVYHCQQYGASAFSFGGGTKLEIK |
| 113 | 1803 | 1803 | RASQTVDKNYVA |
| 113 | 1804 | 1804 | AGGGCCAGTCAGACTGTTGACAAGAACTACGTAGCC |
| 113 | 1805 | 1805 | GASKRAA |
| 113 | 1806 | 1806 | GGTGCATCCAAGAGGGCCGCT |
| 113 | 1807 | 1807 | QQYGASAFS |
| 113 | 1808 | 1808 | CAGCAGTATGGAGCTTCAGCGTTCAGT |
| 114 | 1809 | 1809 | CAGGTGCAGCTGGTGCAATCTGGGGGAGGCTTGGTAAAGCGGGGGGGTCCCTTAGACTCTCATGTGCAGCCTCTGGATTCGCTTTCAGTAACGCCTGGATGAGCTGGGTCCGCCAGGCTCCAGGGAAGGGGCTGGAGTGGCTTGGCCGTATTAAAAGCGAAACTGACGGTGGGACAACAGACTACGCTGCACCCGTGAAAGGCAGATTCAGCATCTCAAGAGATGATTCCAGAAACACGCTGTATCTGCAAATGAACAGCCTGGAAAGCGAGGACACAGCCGTTTATTACTGTACCACAGGCCCACCCTATAAGTATTTTGATAGTACTGGTTATTCGGTCGTTGACTACTGGGGCCAGGGAACCCTGGTCACCGTCTCCTCA |
| 114 | 1810 | 1810 | QVQLVQSGGGLVKPGGSLRLSCAASGFAFSNAWMSWVRQAPGKGLEWLGRIKSETDGGTTDYAAPVKGRFSISRDDSRNTLYLQMNSLESEDTAVYYCTTGPPYKYFDSTGYSVVDYWGQGTLVTVSS |

TABLE 6-continued

Informal Sequence Listing

| Antibody No. | Seq. Ref. No. | SEQ ID NO. | Sequence |
|---|---|---|---|
| 114 | 1811 | 1811 | FAFSNAWMS |
| 114 | 1812 | 1812 | TTCGCTTTCAGTAACGCCTGGATGAGC |
| 114 | 1813 | 1813 | RIKSETDGGTTDYAAPVKG |
| 114 | 1814 | 1814 | CGTATTAAAAGCGAAACTGACGGTGGGACAACAGACTACGCTGCACC CGTGAAAGGC |
| 114 | 1815 | 1815 | TTGPPYKYFDSTGYSVVDY |
| 114 | 1816 | 1816 | ACCACAGGCCCACCCTATAAGTATTTTGATAGTACTGGTTATTCGGTC GTTGACTAC |
| 114 | 1817 | 1817 | TCCTATGAGCTGACACAGCCACCCTCAGCGTCTGGGACCCCCGGGCA GAGGGTCACCATCTCTTGTTCTGGAAGCAGCTCCAATATCGGAAGTA ATTATGTATACTGGTACCAGCAGCTCCCAGGAACGGCCCCCAGACTC CTCATCTATAGTACTAATCAGCGGCCCTCAGGGGTCCCTGACCGATTC TCTGGCTCCCAGTCTGGCACCTCAGCCTCCCTGGCCATCAGTGGGCTC CGGTCCGACGATGAGGCTGATTATTACTGTGCAGCATGGGATGACAG GATGAGTGGTCCGGTGTTCGGCGAGGGACCAAGCTCACCGTCCTA |
| 114 | 1818 | 1818 | SYELTQPPSASGTPGQRVTISCSGSSSNIGSNYVYWYQQLPGTAPRLLIYS TNQRPSGVPDRFSGSQSGTSASLAISGLRSDDEADYYCAAWDDRMSGPV FGGGTKLTVL |
| 114 | 1819 | 1819 | SGSSSNIGSNYVY |
| 114 | 1820 | 1820 | TCTGGAAGCAGCTCCAATATCGGAAGTAATTATGTATAC |
| 114 | 1821 | 1821 | STNQRPS |
| 114 | 1822 | 1822 | AGTACTAATCAGCGGCCCTCA |
| 114 | 1823 | 1823 | AAWDDRMSGPV |
| 114 | 1824 | 1824 | GCAGCATGGGATGACAGGATGAGTGGTCCGGTG |
| 115 | 1825 | 1825 | CAGGTCCAGCTTGTACAGTCTGGGGGAGGCTTGGTGCAGCCTGGGGG GTCCCTAAGACTCTCCTGTGCAGCCTCTGGACTCACCTTTAGCTCTTA TGCCATGTCCTGGGTCCGCCAGGCTCCAGGGAAGGAACTGGAGTGGG TCTCATCTATTAGTGAAAGTGGTGTTGATACATACTACGCAGACTCCG TGAAGGGCCGGTTCACCGTCTCCAGAGACAATTCCAAAAGCACGCTG TATCTGCAAATGAGCAGCCTGGGAGGCGACGACACGGCCGTATATTA TTGCGCGAAGGCATACTGTAGTAATAAGGCCTGCCACGGGGGCTACT TTGACTACTGGGGCCAGGGAACCCTGGTCACCGTCTCCTCA |
| 115 | 1826 | 1826 | QVQLVQSGGGLVQPGGSLRLSCAASGLTFSSYAMSWVRQAPGKELEWV SSISESGVDTYYADSVKGRFTVSRDNSKSTLYLQMSSLGGDDTAVYYCA KAYCSNKACHGGYFDYWGQGTLVTVSS |
| 115 | 1827 | 1827 | LTFSSYAMS |
| 115 | 1828 | 1828 | CTCACCTTTAGCTCTTATGCCATGTCC |
| 115 | 1829 | 1829 | SISESGVDTYYADSVKG |
| 115 | 1830 | 1830 | TCTATTAGTGAAAGTGGTGTTGATACATACTACGCAGACTCCGTGAA GGGC |
| 115 | 1831 | 1831 | AKAYCSNKACHGGYFDY |
| 115 | 1832 | 1832 | GCGAAGGCATACTGTAGTAATAAGGCCTGCCACGGGGGCTACTTTGA CTAC |
| 115 | 1833 | 1833 | GAAACGACACTCACGCAGTCTCCAGACACCCTGTCCTTGTCTCCAGG GGAAAGGGCCACCCTCTCCTGCAGGGCCAGTCAGAGTGTTAGGAACT ACTTAGCCTGGTACCGGCAGAAACCTGGCCAGGCTCCCAGGCTCCTC ATCTATGATGCATCCAACCTGGCCACTGGCATCCCAGCCAGGTTCAGT GGCAGCGGGTCTGGGACAGACTTCACTCTCACCATCAGCAGCCTAGA GCCTGAAGATTTTGCAGTTTATTACTGTCACCAGCGTAGCGACTGGCC GCTCACTTTCGGCCCTGGGACCAAGGTGGAAATCAAA |

TABLE 6-continued

Informal Sequence Listing

| Antibody No. | Seq. Ref. No. | SEQ ID NO. | Sequence |
|---|---|---|---|
| 115 | 1834 | 1834 | ETTLTQSPDTLSLSPGERATLSCRASQSVRNYLAWYRQKPGQAPRLLIYD ASNLATGIPARFSGSGSGTDFTLTISSLEPEDFAVYYCHQRSDWPLTFGPG TKVEIK |
| 115 | 1835 | 1835 | RASQSVRNYLA |
| 115 | 1836 | 1836 | AGGGCCAGTCAGAGTGTTAGGAACTACTTAGCC |
| 115 | 1837 | 1837 | DASNLAT |
| 115 | 1838 | 1838 | GATGCATCCAACCTGGCCACT |
| 115 | 1839 | 1839 | HQRSDWPLT |
| 115 | 1840 | 1840 | CACCAGCGTAGCGACTGGCCGCTCACT |
| 116 | 1841 | 1841 | GAGGTGCAGCTGGTGGAGTCGGGGGGAGGCTTGGTCCAGCCTGGGGG GTCCCTGAGACTCTCCTGTGCAGCCTCTGGATTCACCTTTAGGAGCTA TTGGATGACCTGGGTCCGCCAGGCTCCAGGGAAAGGGCTGGAGTGGG TGGCCAGCATAAACGATGAGGGGAATACTAAATACTATGTGGACTCT CTGAAGGGCCGATTCACCATCTCCAGAGACAACGCCAAGAACTCACT TTATCTCCAAATGAACAGCCTGCGAGCCGAGGACACGGCTGTTTATT ACTGTGCGAGGGAGTCCGGTCTGCCCCGGGGTGCCTTTCAAATCTGG GGCCCAGGGACAATGGTCACCGTCTCTTCA |
| 116 | 1842 | 1842 | EVQLVESGGGLVQPGGSLRLSCAASGFTFRSYWMTWVRQAPGKGLEW VASINDEGNTKYYVDSLKGRFTISRDNAKNSLYLQMNSLRAEDTAVYYC ARESGLPRGAFQIWGPGTMVTVSS |
| 116 | 1843 | 1843 | FTFRSYWMT |
| 116 | 1844 | 1844 | TTCACCTTTAGGAGCTATTGGATGACC |
| 116 | 1845 | 1845 | SINDEGNTKYYVDSLKG |
| 116 | 1846 | 1846 | AGCATAAACGATGAGGGGAATACTAAATACTATGTGGACTCTCTGAA GGGC |
| 116 | 1847 | 1847 | ARESGLPRGAFQI |
| 116 | 1848 | 1848 | GCGAGGGAGTCCGGTCTGCCCCGGGGTGCCTTTCAAATC |
| 116 | 1849 | 1849 | GAAATTGTATTGACACAGTCTCCAGTCACCCTGTCTTTGTCTCCAGGG GAAAGAGCCACCCTCTCATGCAGGGCCAGTCAGAGTGTTGGCACCTT CTTAGCCTGGTATCAACACAAACCTGGCCAGGCTCCCAGGCTCCTCAT CTATGATGCATCCAACAGGGCCTCTGCCATCCCAGCCAGGTTCAGTG GCAGTGGGTCTGGGACAGACTTCACTCTCACCATCAGCAGCCTGGAG CCTGAAGATTTTGCAGTTTATTACTGTCAGCATCGTAGCGACTGGTGG ACGTTCGGCCAAGGGACCAAGGTGGAAATCAAA |
| 116 | 1850 | 1850 | EIVLTQSPVTLSLSPGERATLSCRASQSVGTFLAWYQHKPGQAPRLLIYD ASNRASAIPARFSGSGSGTDFTLTISSLEPEDFAVYYCQHRSDWWTFGQG TKVEIK |
| 116 | 1851 | 1851 | RASQSVGTFLA |
| 116 | 1852 | 1852 | AGGGCCAGTCAGAGTGTTGGCACCTTCTTAGCC |
| 116 | 1853 | 1853 | DASNRAS |
| 116 | 1854 | 1854 | GATGCATCCAACAGGGCCTCT |
| 116 | 1855 | 1855 | QHRSDWWT |
| 116 | 1856 | 1856 | CAGCATCGTAGCGACTGGTGGACG |
| 117 | 1857 | 1857 | CAGGTGCAGCTACAGCAGTGGGGCGCAGGACTGTTGAAGCCTTCGGA GACCCTGTCCCTCACCTGCCAAGTCTATGGTGTGTCCTTCAGTGATTA CTACTGGAACTGGATCCGCCAGTCCCCAGGGAAGGGACTGGAGTGGA TTGGGGACGTCAATCATATTGGAAACACCGACTACAACCCGTCCCTC AAGAGTCGAGTCTCCATATCAGTAGACACGTCCAAGAACCAGTTCTC CCTCACCCTGCGCTCTGTGACCGCCGCAGACACGGCTCTATACTACTG |

TABLE 6-continued

Informal Sequence Listing

| Antibody No. | Seq. Ref. No. | SEQ ID NO. | Sequence |
|---|---|---|---|
| | | | TGCGAGAGGCCGTAAACTTTTTGAAGTGCCTCCCAAGGCCCCCGACT ACTGGGGCCAGGGAACCCTGGTCACCGTCTCCTCA |
| 117 | 1858 | 1858 | QVQLQQWGAGLLKPSETLSLTCQVYGVSFSDYYWNWIRQSPGKGLEWI GDVNHIGNTDYNPSLKSRVSISVDTSKNQFSLTLRSVTAADTALYYCARG RKLFEVPPKAPDYWGQGTLVTVSS |
| 117 | 1859 | 1859 | VSFSDYYWN |
| 117 | 1860 | 1860 | GTGTCCTTCAGTGATTACTACTGGAAC |
| 117 | 1861 | 1861 | DVNHIGNTDYNPSLKS |
| 117 | 1862 | 1862 | GACGTCAATCATATTGGAAACACCGACTACAACCCGTCCCTCAAGAGT |
| 117 | 1863 | 1863 | ARGRKLFEVPPKAPDY |
| 117 | 1864 | 1864 | GCGAGAGGCCGTAAACTTTTTGAAGTGCCTCCCAAGGCCCCCGACTAC |
| 117 | 1865 | 1865 | GATATTGTGATGACGCAGTCTCCAGGCACCCTGTCTTTGTCTCCAGGG GAAAGAGCCACCCTCTCCTGCAGGGCCAGTCAGAGTGTGAGCAGCAC CTACTTAGCCTGGTACCAGCAGAAGCCTGGCCAGGCTCCCAGGCTCC TCATCTATGGTGCGTCCATCAGGGCCACTGGCATCCCAGACAGGTTCA GTGGCGTTGGGTCTGGGACAGACTTCACTCTCACCATCAGCAGACTG GAGCCTGAAGATGTTGCAGTGTATTACTGTCAGCAGTATGGGAGCTC ACCTCAGACGTTCGGCCAAGGGACCAAGGTGGAAATCAAA |
| 117 | 1866 | 1866 | DIVMTQSPGTLSLSPGERATLSCRASQSVSSTYLAWYQQKPGQAPRLLIY GASIRATGIPDRFSGVGSGTDFTLTISRLEPEDVAVYYCQQYGSSPQTFGQ GTKVEIK |
| 117 | 1867 | 1867 | RASQSVSSTYLA |
| 117 | 1868 | 1868 | AGGGCCAGTCAGAGTGTGAGCAGCACCTACTTAGCC |
| 117 | 1869 | 1869 | GASIRAT |
| 117 | 1870 | 1870 | GGTGCGTCCATCAGGGCCACT |
| 117 | 1871 | 1871 | QQYGSSPQT |
| 117 | 1872 | 1872 | CAGCAGTATGGGAGCTCACCTCAGACG |
| 118 | 1873 | 1873 | CAGGTGCAGCTGGTGGAGTCTGGGGGAGGCTTGATTCAGCCTGGGGC GTCCCTGAGACTCTCCTGTGGAGCCTATGGATTCAGTTTCAGCAGCTC TGCCATGAGCTGGGTCCGCCAGGCTCCAGGTAAGGGGCTGGAGTGGG TCTCAGCTATTAGTGATAATGGTGGTAGCACATACTACGCAGACTCCG TGCAGGGCCGGTTCACCATCTCCAGAGACAATTCCAAGAACACGCTG TATCTGCAACTGAACAGGCTGAGAGCCGAGGACACGGCCATATATTA CTGTGCGAAAGCATATTGTAGTGATAGCTGCCACGGGGGCTACTTTG ACTACTGGGGCCAGGGAACCCTGGTCACCGTCTCCTCA |
| 118 | 1874 | 1874 | QVQLVESGGGLIQPGASLRLSCGAYGFSFSSSAMSWVRQAPGKGLEWVS AISDNGGSTYYADSVQGRFTISRDNSKNTLYLQLNRLRAEDTAIYYCAK AYCSDSCHGGYFDYWGQGTLVTVSS |
| 118 | 1875 | 1875 | FSFSSSAMS |
| 118 | 1876 | 1876 | TTCAGTTTCAGCAGCTCTGCCATGAGC |
| 118 | 1877 | 1877 | AISDNGGSTYYADSVQG |
| 118 | 1878 | 1878 | GCTATTAGTGATAATGGTGGTAGCACATACTACGCAGACTCCGTGCA GGGC |
| 118 | 1879 | 1879 | AKAYCSDSCHGGYFDY |
| 118 | 1880 | 1880 | GCGAAAGCATATTGTAGTGATAGCTGCCACGGGGGCTACTTTGACTAC |
| 118 | 1881 | 1881 | GAAATTGTGTTGACGCAGTCTCCAGCCACCCTGTCTTTGTCTCCAGGG GATAGAGCCACCCTCTCCTGCAGGGCCAGTCAGAGTGTTAGCAGCTC CTTCGCCTGGTACCAACAGAAACCTGGCCAGGCTCCCAGGCTCCTCAT CTATGCTGTATCCAACAGGGCCACTGGCATCCCAGCCAGGTTCAGTG GCAGTGGGTCTGGGACAGACTTCACTCTCACCATCAGCACCCTAGAG |

TABLE 6-continued

Informal Sequence Listing

| Antibody No. | Seq. Ref. No. | SEQ ID NO. | Sequence |
|---|---|---|---|
| | | | CCTGAAGACTTTGCAGTTTATTACTGTCAGCAGCGTAGCACCTGGCCG CTCACTTTCGGCCCTGGGACCAAGGTGGAGATCAAA |
| 118 | 1882 | 1882 | EIVLTQSPATLSLSPGDRATLSCRASQSVSSSFAWYQQKPGQAPRLLIYAV SNRATGIPARFSGSGSGTDFTLTISTLEPEDFAVYYCQQRSTWPLTFGPGT KVEIK |
| 118 | 1883 | 1883 | RASQSVSSSFA |
| 118 | 1884 | 1884 | AGGGCCAGTCAGAGTGTTAGCAGCTCCTTCGCC |
| 118 | 1885 | 1885 | AVSNRAT |
| 118 | 1886 | 1886 | GCTGTATCCAACAGGGCCACT |
| 118 | 1887 | 1887 | QQRSTWPLT |
| 118 | 1888 | 1888 | CAGCAGCGTAGCACCTGGCCGCTCACT |
| 119 | 1889 | 1889 | GAGGTGCAGCTGTTGGAGTCGGGGGGAGGCTTGGTAAGCCTGGGGG GTCCCTAAGACTCTCATGTGCAGCCTCTGGATTCATTTTCACTAACGC CTGGATGAGCTGGGTCCGCCAGGCTCCAGGGAAGGGGCTGGAGTGGG TTGGCCGTATTAAAAGGAAAACTGAAACTGGGACAACAGACTACGCT CCACCCGTGAAAGGCAGATTCACCATCTCAAGAGATGATTCAAGAAG CACGCTGTATCTGCAAATGAACAGCCTGAAAACCGAGGACACAGCCG TGTATTACTGTACGACAGGCCCACCCTATCAGTACTATGACAGTACTG GTTATTCGGTCGTTGACTACTGGGGCCAGGGAACCCTGGTCACCGTCT CCTCA |
| 119 | 1890 | 1890 | EVQLLESGGGLVKPGGSLRLSCAASGFIFTNAWMSWVRQAPGKGLEWV GRIKRKTETGTTDYAPPVKGRFTISRDDSRSTLYLQMNSLKTEDTAVYYC TTGPPYQYYDSTGYSVVDYWGQGTLVTVSS |
| 119 | 1891 | 1891 | FIFTNAWMS |
| 119 | 1892 | 1892 | TTCATTTTCACTAACGCCTGGATGAGC |
| 119 | 1893 | 1893 | RIKRKTETGTTDYAPPVKG |
| 119 | 1894 | 1894 | CGTATTAAAAGGAAAACTGAAACTGGGACAACAGACTACGCTCCACC CGTGAAAGGC |
| 119 | 1895 | 1895 | TTGPPYQYYDSTGYSVVDY |
| 119 | 1896 | 1896 | ACGACAGGCCCACCCTATCAGTACTATGACAGTACTGGTTATTCGGTC GTTGACTAC |
| 119 | 1897 | 1897 | TCCTATGAGCTGACTCAGCCACCCTCAGCGTCCGGGACCCCCGGGCA GAGGGTCACCATCTCTTGTTCTGGAAGCAGCTCCAACATCGGAAGTA ACATCGGAATTAATTATGTATACTGGTACCAGCAGCTCCCAGGAACG GCCCCCAAACTCCTCATCTACAGTACTAATCAGCGGCCCTCAGGGGTC CCTGACCGATTCTCTGGCTCCCAGTCTGGCACCTCAGCCTCCCTGGCC ATCAGTGGGCTCCGGTCCGAGGATGAGGCTGATTATTACTGTGCAGC ATGGGATGACAGCCTGAGTGGTCCGGTGTTCGGCGGAGGGACCAAGC TCACCGTCCTA |
| 119 | 1898 | 1898 | SYELTQPPSASGTPGQRVTISCSGSSSNIGSNIGINYVYWYQQLPGTAPKL LIYSTNQRPSGVPDRFSGSQSGTSASLAISGLRSEDEADYYCAAWDDSLS GPVFGGGTKLTVL |
| 119 | 1899 | 1899 | SGSSSNIGSNIGINYVY |
| 119 | 1900 | 1900 | TCTGGAAGCAGCTCCAACATCGGAAGTAACATCGGAATTAATTATGT ATAC |
| 119 | 1901 | 1901 | STNQRPS |
| 119 | 1902 | 1902 | AGTACTAATCAGCGGCCCTCA |
| 119 | 1903 | 1903 | AAWDDSLSGPV |
| 119 | 1904 | 1904 | GCAGCATGGGATGACAGCCTGAGTGGTCCGGTG |

TABLE 6-continued

Informal Sequence Listing

| Antibody No. | Seq. Ref. No. | SEQ ID NO. | Sequence |
|---|---|---|---|
| 120 | 1905 | 1905 | CAGGTGCAGCTGGTGCAGTCTGGACCAGAGTTGAAAAAGCCCGGGGA GTCTCTGAAGATCTCCTGTAAGGCTTCTGGATACAGCTTTACCTCCTT CTGGATCGCTTGGGTGCGCCAGATGCCCGGGAAAGGCCTGGAGTTTC TGGGGATCATCTATCCTGGTGACGCTGACACCAGATACAGTCCGTCCT TCCAAGGCCAAGTCACCATCTCAGCCGACAAGTCCATCAACACCGCC TACCTGCAGTGGAACAACCTGAAGGCCTCGGACACCGCCATGTATTA CTGTGCGAGACAGACTACGATGACCCCCGATGCTTTTGATCTCTGGGG CCAAGGGACCACGGTCACCGTCTCCTCA |
| 120 | 1906 | 1906 | QVQLVQSGPELKKPGESLKISCKASGYSFTSFWIAWVRQMPGKGLEFLGI IYPGDADTRYSPSFQGQVTISADKSINTAYLQWNNLKASDTAMYYCARQ TTMTPDAFDLWGQGTTVTVSS |
| 120 | 1907 | 1907 | YSFTSFWIA |
| 120 | 1908 | 1908 | TACAGCTTTACCTCCTTCTGGATCGCT |
| 120 | 1909 | 1909 | IIYPGDADTRYSPSFQG |
| 120 | 1910 | 1910 | ATCATCTATCCTGGTGACGCTGACACCAGATACAGTCCGTCCTTCCAA GGC |
| 120 | 1911 | 1911 | ARQTTMTPDAFDL |
| 120 | 1912 | 1912 | GCGAGACAGACTACGATGACCCCCGATGCTTTTGATCTC |
| 120 | 1913 | 1913 | GAAATTGTGTTGACACAGTCTCCAGCCACCCTGTCTTTGTCTCCAGGG GAAAGAGCCACTATCTCCTGCAGGGCCAGTCAGAGTGTTAGCAGCTA CTTAGCCTGGTACCAACAGAAACCTGGCCAGGCTCCCAGGCTCCTCA TCTATGAAGCATCCGACAGGGCCACTGGCACCCCAGCCAGGTTCAGT GGCAGTGGGTCTGGGACAGACTTCACTCTCACCATCAGCAGCCTAGA GCCTGAGGATTTTGCAGTTTATTACTGTCAGCAGCGTAGTAACTGGGG GGTAGGAACGTTCGGCCAAGGGACCAAGGTGGAAATCAAA |
| 120 | 1914 | 1914 | EIVLTQSPATLSLSPGERATISCRASQSVSSYLAWYQQKPGQAPRLLIYEA SDRATGTPARFSGSGSGTDFTLTISSLEPEDFAVYYCQQRSNWGVGTFGQ GTKVEIK |
| 120 | 1915 | 1915 | RASQSVSSYLA |
| 120 | 1916 | 1916 | AGGGCCAGTCAGAGTGTTAGCAGCTACTTAGCC |
| 120 | 1917 | 1917 | EASDRAT |
| 120 | 1918 | 1918 | GAAGCATCCGACAGGGCCACT |
| 120 | 1919 | 1919 | QQRSNWGVGT |
| 120 | 1920 | 1920 | CAGCAGCGTAGTAACTGGGGGGTAGGAACG |
| 121 | 1921 | 1921 | CAGGTGCAGCTGGTGCAGTCTGGGGCTGAGGTGAAGAAGCCTGGGTC CTCGGTGAGGGTCACCTGCAAGGCTTCTGGAGGCACCGTCAGCGACT ATGCAATCACCTGGGTCCGACAGGCGCCTGGACAAGGGCTTGAGTGG ATGGGAGGGTTCATCCCTATGTTTGGTGTCGCAAAGGACGCAGAGAA GTTCCAGGGCAGAGTCACGCTGACTGGGGACAAATCCACGAACGCAG TTTACATGGAGCTGAGCAGCCTGACATCTGAAGACACGGCCGTCTAT TACTGTGCGAGATCGAAGAGACTACCAGCTGGTTTATCTACGTCTGAC TACTACTACTACTATTTGGACGTCTGGGGCAAAGGGACCACGGTCAC CGTCTCCTCA |
| 121 | 1922 | 1922 | QVQLVQSGAEVKKPGSSVRVTCKASGGTVSDYAITWVRQAPGQGLEW MGGFIPMFGVAKDAEKFQGRVTLTGDKSTNAVYMELSSLTSEDTAVYY CARSKRLPAGLSTSDYYYYLDVWGKGTTVTVSS |
| 121 | 1923 | 1923 | GTVSDYAIT |
| 121 | 1924 | 1924 | GGCACCGTCAGCGACTATGCAATCACC |
| 121 | 1925 | 1925 | GFIPMFGVAKDAEKFQG |
| 121 | 1926 | 1926 | GGGTTCATCCCTATGTTTGGTGTCGCAAAGGACGCAGAGAAGTTCCA GGGC |

TABLE 6-continued

Informal Sequence Listing

| Antibody No. | Seq. Ref. No. | SEQ ID NO. | Sequence |
|---|---|---|---|
| 121 | 1927 | 1927 | ARSKRLPAGLSTSDYYYYLDV |
| 121 | 1928 | 1928 | GCGAGATCGAAGAGACTACCAGCTGGTTTATCTACGTCTGACTACTACTACTACTATTTGGACGTC |
| 121 | 1929 | 1929 | GAAATTGTATTGACACAGTCTCCAGGCACCCTGTCTTTGTCTCCAGGGGAAGGAGCCACCCTCTCCTGTACGGCCAGTCAGAATGTTTTCCGCACCCACGTAGCCTGGTACCAGCAGACTCCTGGCCAGGCTCCCAGGCTCCTCATCTATGGTGGGTCCACCAGGGCCACTGGCATCCCAGACAGGTTCAGTGGCAGCGGGTCTGGGACAGACTTCACTCTCATCATCAGCAGACTGGAACCTGAAGATTTTGCAGTCTATTACTGTCATCACTTTGGTACCACACCGTGGACGTTCGGCCAAGGGACCAAGGTGGAGATCAAA |
| 121 | 1930 | 1930 | EIVLTQSPGTLSLSPGEGATLSCTASQNVFRTHVAWYQQTPGQAPRLLIYGGSTRATGIPDRFSGSGSGTDFTLIISRLEPEDFAVYYCHHFGTTPWTFGQGTKVEIK |
| 121 | 1931 | 1931 | TASQNVFRTHVA |
| 121 | 1932 | 1932 | ACGGCCAGTCAGAATGTTTTCCGCACCCACGTAGCC |
| 121 | 1933 | 1933 | GGSTRAT |
| 121 | 1934 | 1934 | GGTGGGTCCACCAGGGCCACT |
| 121 | 1935 | 1935 | HHFGTTPWT |
| 121 | 1936 | 1936 | CATCACTTTGGTACCACACCGTGGACG |
| 122 | 1937 | 1937 | GAGGTGCAGCTGGTGGAGTCTGGGCCTGAGGTGAAGGGGCCTGGGTCCTCGGTGAAAGTCTCATGCGAGGCTTCTGCAGCCACCTTCAGCAACTACGCTATCAGCTGGGTCCGACAGGCCCCTGGACAAGGGCTTGAGTGGATGGGAGGGTTCGTCCCTATGTTAGGGACAAGGAACTACGCACAGAAGTTCAAGGGCAGAGTCACTCTGACCGCGGACGTATCCACACATCATTGTACTTGGAGATTGGTAGTCTGAGATTTGAGGACACGGCCGTGTATTACTGTGCGACAGTGGCCGGTCTGGGAACCAGCTATGGTCGATACCTTGAGTCTTGGGGCCAGGGAACCCTGGTCACCGTCTCCTCA |
| 122 | 1938 | 1938 | EVQLVESGPEVKGPGSSVKVSCEASAATFSNYAISWVRQAPGQGLEWMGGFVPMLGTRNYAQKFKGRVTLTADVSTHTLYLEIGSLRFEDTAVYYCATVAGLGTSYGRYLESWGQGTLVTVSS |
| 122 | 1939 | 1939 | ATFSNYAIS |
| 122 | 1940 | 1940 | GCCACCTTCAGCAACTACGCTATCAGC |
| 122 | 1941 | 1941 | GFVPMLGTRNYAQKFKG |
| 122 | 1942 | 1942 | GGGTTCGTCCCTATGTTAGGGACAAGGAACTACGCACAGAAGTTCAAGGGC |
| 122 | 1943 | 1943 | ATVAGLGTSYGRYLES |
| 122 | 1944 | 1944 | GCGACAGTGGCCGGTCTGGGAACCAGCTATGGTCGATACCTTGAGTCT |
| 122 | 1945 | 1945 | GACATCCGGATGACCCAGTCTCCATCTTCTGTGTCTGCGTCTCTTGGAGACAGAGTCACCATCACTTGTCGGGCGAGTCAGGATATTAGCACCGCGTTAGCCTGGTATCAGCAGATACCAGGGAAGGCCCCTAAACTCCTGATCTATGAAGCATCCAGTTTGCAAAGTGGGGTCCCATCCAGGTTCAGGGGCAGTGGATCTGAGACAGACTTCGCTCTCACTATCAGCAGCCTGCAGCCTGAAGATTTTGCAACTTACTATTGTCAACAGGCAAAGAGTTTCCCGTACACTTTTGGCCAGGGGACCAAGGTGGAGATCAAA |
| 122 | 1946 | 1946 | DIRMTQSPSSVSASLGDRVTITCRASQDISTALAWYQQIPGKAPKLLIYEASSLQSGVPSRFRGSGSETDFALTISSLQPEDFATYYCQQAKSFPYTFGQGTKVEIK |
| 122 | 1947 | 1947 | RASQDISTALA |
| 122 | 1948 | 1948 | CGGGCGAGTCAGGATATTAGCACCGCGTTAGCC |
| 122 | 1949 | 1949 | EASSLQS |
| 122 | 1950 | 1950 | GAAGCATCCAGTTTGCAAAGT |

TABLE 6-continued

Informal Sequence Listing

| Antibody No. | Seq. Ref. No. | SEQ ID NO. | Sequence |
|---|---|---|---|
| 122 | 1951 | 1951 | QQAKSFPYT |
| 122 | 1952 | 1952 | CAACAGGCAAAGAGTTTCCCGTACACT |
| 123 | 1953 | 1953 | CAGGTCCAGCTGGTGCAGTCTGGGGGAGGCTTGGCGCAGCCTGGAGG<br>GTCCCTGAGACTCTCCTGTGCAGCCTCCGGATTCATCTTCAGTGTTTA<br>TGAAATGGACTGGGTCCGCCAGGCTCCAGGGAAGGGGCTGGAGTGGC<br>TTTCATACATTGATATTACTGGTAATAGTGTAACCTATGCAGACTCTG<br>TGAGGGGCCGGTTCACCATCTCCAGAGACAACGCCAGGAACTCACTC<br>TACCTGCAAATGGACAGCCTGAGAGTCGAGGACACGGCTGTATATTA<br>TTGTGTTAGAGATAGTCGCGGCCCTACAACGCAGTGGCTCACGGGAT<br>ACTTTGACTTCTGGGGCCAGGGGACCACGGTCACCGTCTCCTCA |
| 123 | 1954 | 1954 | QVQLVQSGGGLAQPGGSLRLSCAASGFIFSVYEMDWVRQAPGKGLEWL<br>SYIDITGNSVTYADSVRGRFTISRDNARNSLYLQMDSLRVEDTAVYYCV<br>RDSRGPTTQWLTGYFDFWGQGTTVTVSS |
| 123 | 1955 | 1955 | FIFSVYEMD |
| 123 | 1956 | 1956 | TTCATCTTCAGTGTTTATGAAATGGAC |
| 123 | 1957 | 1957 | YIDITGNSVTYADSVRG |
| 123 | 1958 | 1958 | TACATTGATATTACTGGTAATAGTGTAACCTATGCAGACTCTGTGAGG<br>GGC |
| 123 | 1959 | 1959 | VRDSRGPTTQWLTGYFDF |
| 123 | 1960 | 1960 | GTTAGAGATAGTCGCGGCCCTACAACGCAGTGGCTCACGGGATACTT<br>TGACTTC |
| 123 | 1961 | 1961 | GACATCCGGATGACCCAGTCTCCAGCCACCCTGTCTTTGTCTCCAGGG<br>GAAAGAGCCACCCTCTCCTGCAGGGCCAGTCAGAGTGTTAGCAACTA<br>CTTAGCCTGGTACCAACAGAAACCTGGCCAGGCTCCCAGGCTCCTCA<br>TCTATGATGTATCCAATAGGGCCACTGGCATCCCAGCCAGGTTCAGTG<br>GCAGTGGGTCCGGGACAGACTTCACTCTCACCATCAGCAGCCTGGAG<br>CCTGAAGATTTTGCAGTTTATTACTGTCAGCAGCGTCGCAACTGGCCT<br>CCGCTCACTTTCGGCGGAGGGACCAAGGTGGAGGTCAAA |
| 123 | 1962 | 1962 | DIRMTQSPATLSLSPGERATLSCRASQSVSNYLAWYQQKPGQAPRLLIYD<br>VSNRATGIPARFSGSGSGTDFTLTISSLEPEDFAVYYCQQRRNWPPLTFGG<br>GTKVEVK |
| 123 | 1963 | 1963 | RASQSVSNYLA |
| 123 | 1964 | 1964 | AGGGCCAGTCAGAGTGTTAGCAACTACTTAGCC |
| 123 | 1965 | 1965 | DVSNRAT |
| 123 | 1966 | 1966 | GATGTATCCAATAGGGCCACT |
| 123 | 1967 | 1967 | QQRRNWPPLT |
| 123 | 1968 | 1968 | CAGCAGCGTCGCAACTGGCCTCCGCTCACT |

Additional Embodiments

Embodiment 1. An isolated antibody or an antigen-binding fragment thereof that specifically binds to Respiratory Syncytial Virus (RSV) F protein (F), wherein at least one of the CDRH1, a CDRH2, a CDRH3, a CDRL1, a CDRL2, and CDRL3 amino acid sequence of the antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to at least one of the CDRH1, a CDRH2, a CDRH3, a CDRL1, a CDRL2, and/or a CDRL3 amino acid sequences as disclosed in Table 6 of an antibody selected from Antibody Number 1 through Antibody Number 123 as disclosed in Table 6; and wherein said antibody or the antigen-binding fragment thereof also has one or more of the following characteristics:

a) the antibody or antigen-binding fragment thereof cross-competes with said antibody or antigen-binding fragment thereof for binding to RSV-F;

b) the antibody or antigen-binding fragment thereof displays better binding affinity for the PreF form of RSV-F relative to the PostF form;

c) the antibody or antigen-binding fragment thereof displays a clean or low polyreactivity profile;

d) the antibody or antigen-binding fragment thereof displays neutralization activity toward RSV subtype A and RSV subtype B in vitro;

e) the antibody or antigen-binding fragment thereof displays antigenic site specificity for RSV-F at Site Ø, Site I, Site II, Site III, Site IV, or Site V;

f) the antibody or antigen-binding fragment thereof displays antigenic site specificity for RSV-F Site Ø, Site V, or Site III relative to RSV-F Site I, Site II, or Site IV;

g) at least a portion of the epitope with which the antibody or antigen-binding fragment thereof interacts comprises the α3 helix and β3/β4 hairpin of PreF;

h) the antibody or antigen-binding fragment thereof displays an in vitro neutralization potency ($IC_{50}$) of between about 0.5 microgram/milliliter (ug/ml) to about 5 ug/ml; between about 0.05 ug/ml to about 0.5 ug/ml; or less than about 0.05 mg/ml;

i) the binding affinity and/or epitopic specificity of the antibody or antigen-binding fragment thereof for any one of the RSV-F variants designated as 1, 2, 3, 4, 5, 6, 7, 8, 9, and DG in FIG. 7A is reduced or eliminated relative to the binding affinity and/or epitopic specificity of said antibody or antigen-binding fragment thereof for the RSV-F or RSV-F DS-Cav1;

j) the antibody or antigen-binding fragment thereof of displays a cross-neutralization potency ($IC_{50}$) against human metapneumovirus (HMPV);

k) the antibody or antigen-binding fragment thereof does not complete with D25, MPE8, palivisumab, motavizumab, or AM-14; or l) the antibody or antigen-binding fragment thereof displays at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency (IC50) than D25 and/or palivizumab.

Embodiment 2. The isolated antibody or antigen-binding fragment thereof of Embodiment 1, wherein the antibody or antigen-binding fragment thereof comprises: at least two; at least three; at least 4; at least 5; at least 6; at least 7; at least 8; at least 9; at least 10; at least 11; or at least 12; of characteristics a) through l).

Embodiment 3. The isolated antibody or antigen-binding fragment thereof of Embodiment 1 or 2, wherein the antibody or antigen-binding fragment thereof comprises:

a) the CDRH3 amino acid sequence of any one of the antibodies designated Antibody Number 1 through Antibody Number 123 as disclosed in Table 6;

b) the CDRH2 amino acid sequence of any one of the antibodies designated Antibody Number 1 through Antibody Number 123 as disclosed in Table 6;

c) the CDRH1 amino acid sequence of any one of the antibodies designated Antibody Number 1 through Antibody Number 123 as disclosed in Table 6;

d) the CDRL3 amino acid sequence of any one of the antibodies designated Antibody Number 1 through Antibody Number 123 as disclosed in Table 6;

e) the CDRL2 amino acid sequence of any one of the antibodies designated Antibody Number 1 through Antibody Number 123 as disclosed in Table 6;

f) the CDRL1 amino acid sequence of any one of the antibodies designated Antibody Number 1 through Antibody Number 123 as disclosed in Table 6; or g) any combination of two or more of a), b), c), d), e), and f).

Embodiment 4. The isolated antibody or antigen-binding fragment thereof of any one of Embodiments 1 through 3, wherein the antibody or antigen-binding fragment thereof comprises:

a) a heavy chain (HC) amino acid sequence of any one of the antibodies designated Antibody Number 1 through Antibody Number 123 as disclosed in Table 6; and/or b) a light chain (LC) amino acid sequence of any one of the antibodies designated Antibody Number 1 through Antibody Number 123 as disclosed in Table 6.

Embodiment 5. The isolated antibody or antigen-binding fragment thereof of any one of Embodiments 1 through 4, wherein the antibody is selected from the group consisting antibodies that are at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to any one of the antibodies designated as Antibody Number 1 through Antibody Number 123 as disclosed in Table 6.

Embodiment 6. The isolated antibody or antigen-binding fragment thereof of any one of Embodiments 1 through 5, wherein the antibody is selected from the group consisting of the antibodies designated as Antibody 1 through Antibody Number 123 as disclosed in Table 6.

Embodiment 7. An isolated nucleic acid sequence encoding an antibody or antigen-binding fragment thereof according to any one of Embodiments 1 through 6.

Embodiment 8. An expression vector comprising the isolated nucleic acid sequence according to Embodiment 7.

Embodiment 9. A host cell transfected, transformed, or transduced with the nucleic acid sequence according to Embodiment 7 or the expression vector according to Embodiment 8.

Embodiment 10. A pharmaceutical composition comprising: one or more of the isolated antibodies or antigen-binding fragments thereof according to any one of Embodiments 1 through 6; and a pharmaceutically acceptable carrier and/or excipient.

Embodiment 11. A pharmaceutical composition comprising: one or more nucleic acid sequences according to Embodiment 7; or one or more the expression vectors according to Embodiment 8; and a pharmaceutically acceptable carrier and/or excipient.

Embodiment 12. A transgenic organism comprising the nucleic acid sequence according to Embodiment 7; or the expression vector according to Embodiment 8.

Embodiment 13. A method of treating or preventing a Respiratory Syncytial Virus (RSV) infection, or at least one symptom associated with RSV infection, comprising administering to a patient in need thereof or suspected of being in need thereof:

a) one or more antibodies or antigen-binding fragments thereof according to any of Embodiments 1 through 6;

b) a nucleic acid sequences according to Embodiment 7;

c) an expression vector according to Embodiment 8;

d) a host cell according to Embodiment 9; or e) a pharmaceutical composition according to Embodiment 10 or Embodiment 11; such that the RSV infection is treated or prevented, or the at least on symptom associated with RSV infection is treated, alleviated, or reduced in severity.

Embodiment 14. A method of treating or preventing either a Respiratory Syncytial Virus (RSV) infection or a human metapneumovirus (HMPV) infection, or at least one symptom associated with said RSV infection or said HMPV infection, comprising administering to a patient in need thereof or suspected of being in need thereof:

a) one or more antibodies or antigen-binding fragments thereof according to any of Embodiments 1 through 6;

b) a nucleic acid sequences according to Embodiment 7;

c) an expression vector according to Embodiment 8;

d) a host cell according to Embodiment 9; or e) a pharmaceutical composition according Embodiment 10 or Embodiment 11; such that the RSV infection is treated or prevented, or the at least on symptom associated with RSV infection is treated, alleviated, or reduced in severity.

Embodiment 15. The method according to Embodiment 14, wherein the one or more antibodies or antigen-binding fragments thereof of a) is selected from the group consisting of the antibodies designated as Antibody Number 4, 11, or 62 as disclosed in Table 6.

Embodiment 16. The method according to any one of Embodiments 13 through 15, wherein the method further comprises administering to the patient a second therapeutic agent.

Embodiment 17. The method according to Embodiment 16, wherein the second therapeutic agent is selected from the group consisting of: an antiviral agent; a vaccine specific for RSV, a vaccine specific for influenza virus, or a vaccine specific for metapneumovirus (MPV); an siRNA specific for an RSV antigen or a metapneumovirus (MPV) antigen; a second antibody specific for an RSV antigen or a metapneumovirus (MPV) antigen; an anti-IL4R antibody, an antibody specific for an influenza virus antigen, an anti-RSV-G antibody and a NSAID.

Embodiment 18. A pharmaceutical composition comprising any one or more of the isolated antibodies or antigen-binding fragments thereof of any one of Embodiments 1 through 7 and a pharmaceutically acceptable carrier and/or excipient.

Embodiment 19. The pharmaceutical composition according to Embodiment 18 for use in preventing a respiratory syncytial virus (RSV) infection in a patient in need thereof or suspected of being in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration as a result of such use.

Embodiment 20. The pharmaceutical composition according to Embodiment 18 for use in treating or preventing either a Respiratory Syncytial Virus (RSV) infection or a human metapneumovirus (HMPV) infection, or at least one symptom associated with said RSV infection or said HMPV infection, in a patient in need thereof or suspected of being in need thereof, wherein the infection is either prevented, or at least one symptom or complication associated with the infection is prevented, ameliorated, or lessened in severity and/or duration as a result of such use.

Embodiment 21. Use of the pharmaceutical composition of Embodiment 18 in the manufacture of a medicament for preventing a respiratory syncytial virus (RSV) infection in a patient in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration.

Embodiment 22. Use of the pharmaceutical composition of Embodiment 18 in the manufacture of a medicament for preventing either a Respiratory Syncytial Virus (RSV) infection or a human metapneumovirus (HMPV) infection, or at least one symptom associated with said RSV infection or said HMPV infection, in a patient in need thereof or suspected of being in need thereof, wherein the infection is either prevented, or at least one symptom or complication associated with the infection is prevented, ameliorated, or lessened in severity and/or duration as a result of such use.

Embodiment A1. An isolated antibody or an antigen-binding fragment thereof that specifically binds to Respiratory Syncytial Virus (RSV) F protein (F), wherein at least one, at least two of, at least three of, at least four of, at least five of, or six of the CDRH1, a CDRH2, a CDRH3, a CDRL1, a CDRL2, and CDRL3 amino acid sequence of the antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99%; at least 100% and/or all percentages of identity in between; to at least one of, at least two of, at least three of, at least four of, at least five of, or six of the CDRH1, a CDRH2, a CDRH3, a CDRL1, a CDRL2, and/or a CDRL3 amino acid sequences as disclosed in Table 6 of an antibody selected from Antibody Number 1 through Antibody Number 123 as disclosed in Table 6; and wherein said antibody or the antigen-binding fragment thereof also has one or more of the following characteristics:

a) the antibody or antigen-binding fragment thereof cross-competes with said antibody or antigen-binding fragment thereof for binding to RSV-F;

b) the antibody or antigen-binding fragment thereof displays better binding affinity for the PreF form of RSV-F relative to the PostF form;

c) the antibody or antigen-binding fragment thereof displays a clean or low polyreactivity profile;

d) the antibody or antigen-binding fragment thereof displays neutralization activity toward RSV subtype A and RSV subtype B in vitro;

e) the antibody or antigen-binding fragment thereof displays antigenic site specificity for RSV-F at Site Ø, Site I, Site II, Site III, Site IV, or Site V;

f) the antibody or antigen-binding fragment thereof displays antigenic site specificity for RSV-F Site Ø, Site V, or Site III relative to RSV-F Site I, Site II, or Site IV;

g) at least a portion of the epitope with which the antibody or antigen-binding fragment thereof interacts comprises the α3 helix and β3/β4 hairpin of PreF;

h) the antibody or antigen-binding fragment thereof displays an in vitro neutralization potency ($IC_{50}$) of between about 0.5 microgram/milliliter (μg/ml) to about 5 μg/ml; between about 0.05 μg/ml to about 0.5 μg/ml; or less than about 0.05 mg/ml;

i) the binding affinity and/or epitopic specificity of the antibody or antigen-binding fragment thereof for any one of the RSV-F variants designated as 1, 2, 3, 4, 5, 6, 7, 8, 9, and DG in FIG. 7A is reduced or eliminated relative to the binding affinity and/or epitopic specificity of said antibody or antigen-binding fragment thereof for the RSV-F or RSV-F DS-Cav1;

j) the antibody or antigen-binding fragment thereof of displays a cross-neutralization potency ($IC_{50}$) against human metapneumovirus (HMPV);

k) the antibody or antigen-binding fragment thereof does not complete with D25, MPE8, palivisumab, motavizumab, or AM-14; or l) the antibody or antigen-binding fragment thereof displays at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency ($IC_{50}$) than D25 and/or palivizumab.

Embodiment A2. The isolated antibody or antigen-binding fragment thereof of Embodiment A1, wherein the antibody or antigen-binding fragment thereof comprises: at least two; at least three; at least 4; at least 5; at least 6; at least 7; at least 8; at least 9; at least 10; at least 11; or at least 12; of characteristics a) through l).

Embodiment A3. The isolated antibody or antigen-binding fragment thereof of Embodiment A1 or A2, wherein the antibody or antigen-binding fragment thereof comprises:

a) the CDRH3 amino acid sequence of any one of the antibodies designated Antibody Number 1 through Antibody Number 123 as disclosed in Table 6;

b) the CDRH2 amino acid sequence of any one of the antibodies designated Antibody Number 1 through Antibody Number 123 as disclosed in Table 6;

c) the CDRH1 amino acid sequence of any one of the antibodies designated Antibody Number 1 through Antibody Number 123 as disclosed in Table 6;

d) the CDRL3 amino acid sequence of any one of the antibodies designated Antibody Number 1 through Antibody Number 123 as disclosed in Table 6;

e) the CDRL2 amino acid sequence of any one of the antibodies designated Antibody Number 1 through Antibody Number 123 as disclosed in Table 6;

f) the CDRL1 amino acid sequence of any one of the antibodies designated Antibody Number 1 through Antibody Number 123 as disclosed in Table 6; or g) any combination of two or more of a), b), c), d), e), and f).

Embodiment A4. The isolated antibody or antigen-binding fragment thereof of any one of Embodiments A1 through A3, wherein the antibody or antigen-binding fragment thereof comprises:

a) a heavy chain (HC) amino acid sequence of any one of the antibodies designated Antibody Number 1 through Antibody Number 123 as disclosed in Table 6; and/or b) a light chain (LC) amino acid sequence of any one of the antibodies designated Antibody Number 1 through Antibody Number 123 as disclosed in Table 6.

Embodiment A5. The isolated antibody or antigen-binding fragment thereof of any one of Embodiments 1 through 4, wherein the antibody is selected from the group consisting antibodies that are at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to any one of the antibodies designated as Antibody Number 1 through Antibody Number 123 as disclosed in Table 6.

Embodiment A6. The isolated antibody or antigen-binding fragment thereof of any one of Embodiments A1 through A5, wherein the antibody is selected from the group consisting of the antibodies designated as Antibody 1 through Antibody Number 123 as disclosed in Table 6.

Embodiment A7. An isolated nucleic acid sequence encoding an antibody or antigen-binding fragment thereof according to any one of Embodiments A1 through A6.

Embodiment A8. An expression vector comprising the isolated nucleic acid sequence according to Embodiment A7.

Embodiment A9. A host cell transfected, transformed, or transduced with the nucleic acid sequence according to Embodiment A7 or the expression vector according to Embodiment A8.

Embodiment A10. A pharmaceutical composition comprising: one or more of the isolated antibodies or antigen-binding fragments thereof according to any one of Embodiments A1 through A6; and a pharmaceutically acceptable carrier and/or excipient.

Embodiment A11. A pharmaceutical composition comprising: one or more nucleic acid sequences according to Embodiment A7; or one or more the expression vectors according to Embodiment A8; and a pharmaceutically acceptable carrier and/or excipient.

Embodiment A12. A pharmaceutical composition comprising a first nucleic acid sequence encoding the light chain of an antibody or antigen-binding fragment according to any one of Embodiments A1 through A6 and a second nucleic acid sequence encoding the heavy chain of an antibody or antigen binding fragment according to any one of Embodiments A1 through A6.

Embodiment A13. A first pharmaceutical composition comprising a first nucleic acid sequence encoding the light chain of an antibody or antigen-binding fragment according to any one of Embodiments A1 through A6 and a second pharmaceutical composition comprising a second nucleic acid sequence encoding the heavy chain of an antibody or antigen binding fragment according to any one of Embodiments A1 through A6, wherein upon coadministration of the first and second pharmaceutical compositions to the subject, an antibody of the invention or antigen binding fragment thereof is expressed in the subject.

Embodiment A14. A transgenic organism comprising the nucleic acid sequence according to Embodiment A7 or the expression vector according to Embodiment A8.

Embodiment A15. A method of treating or preventing a Respiratory Syncytial Virus (RSV) infection, or at least one symptom associated with RSV infection, comprising administering to a patient in need thereof or suspected of being in need thereof:

a) one or more antibodies or antigen-binding fragments thereof according to any of Embodiments A1 through A6;

b) a nucleic acid sequences according to Embodiment A7;

c) an expression vector according to Embodiment A8;

d) a host cell according to Embodiment A9; or e) a pharmaceutical composition according to any one of Embodiment A10 through Embodiment A13, such that the RSV infection is treated or prevented, or the at least on symptom associated with RSV infection is treated, alleviated, or reduced in severity.

Embodiment A16. A method of treating or preventing either a Respiratory Syncytial Virus (RSV) infection and/or a human metapneumovirus (HMPV) infection, or at least one symptom associated with said RSV infection and/or said HMPV infection, comprising administering to a patient in need thereof or suspected of being in need thereof:

a) one or more antibodies or antigen-binding fragments thereof according to any of Embodiments A1 through A6;

b) a nucleic acid sequences according to Embodiment A7;

c) an expression vector according to Embodiment A8;
d) a host cell according to Embodiment A9; or
e) a pharmaceutical composition according to any one of Embodiment A10 through Embodiment A13, such that the RSV infection and/or HMPV infection is treated or prevented, or the at least on symptom associated with RSV infection and/or HMPV infection is treated, alleviated, or reduced in severity.

Embodiment A17. The method according to Embodiment A16, wherein the one or more antibodies or antigen-binding fragments thereof of a) is selected from the group consisting of the antibodies designated as Antibody Number 4, 11, or 62 as disclosed in Table 6.

Embodiment A18. The method according to any one of Embodiments A15 through A17, wherein the method further comprises administering to the patient a second therapeutic agent.

Embodiment A19. The method according to Embodiment A18, wherein the second therapeutic agent is selected group consisting of: an antiviral agent; a vaccine specific for RSV, a vaccine specific for influenza virus, or a vaccine specific for metapneumovirus (MPV); an siRNA specific for an RSV antigen or a metapneumovirus (MPV) antigen; a second antibody specific for an RSV antigen or a metapneumovirus (MPV) antigen; an anti-IL4R antibody, an antibody specific for an influenza virus antigen, an anti-RSV-G antibody and a NSAID.

Embodiment A20. A pharmaceutical composition comprising any one or more of the isolated antibodies or antigen-binding fragments thereof or a nucleic acid molecule encoding said isolated antibody or antigen-binding fragment thereof of any one of Embodiments A1 through A7 and a pharmaceutically acceptable carrier and/or excipient.

Embodiment A21. The pharmaceutical composition according to Embodiment A20 for use in preventing a respiratory syncytial virus (RSV) infection in a patient in need thereof or suspected of being in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration as a result of such use.

Embodiment A22. The pharmaceutical composition according to Embodiment A20 for use in treating or preventing either a Respiratory Syncytial Virus (RSV) infection and/or a human metapneumovirus (HMPV) infection, or at least one symptom associated with said RSV infection and/or said HMPV infection, in a patient in need thereof or suspected of being in need thereof, wherein the infection(s) is/are either prevented, or at least one symptom or complication associated with the infection(s) is prevented, ameliorated, or lessened in severity and/or duration as a result of such use.

Embodiment A23. Use of the pharmaceutical composition of Embodiment 18 in the manufacture of a medicament for preventing a respiratory syncytial virus (RSV) infection in a patient in need thereof, or for treating a patient suffering from an RSV infection, or for ameliorating at least one symptom or complication associated with the infection, wherein the infection is either prevented, or at least one symptom or complication associated with the infection is prevented, ameliorated, or lessened in severity and/or duration.

Embodiment A24. Use of the pharmaceutical composition of Embodiment A20 in the manufacture of a medicament for preventing either a Respiratory Syncytial Virus (RSV) infection and/or a human metapneumovirus (HMPV) infection, or at least one symptom associated with said RSV infection and/or said HMPV infection, in a patient in need thereof or suspected of being in need thereof, wherein the infection(s) is/are either prevented, or at least one symptom or complication associated with the infection(s) is prevented, ameliorated, or lessened in severity and/or duration as a result of such use.

SEQUENCE LISTING (2259 sequences)

SEQ ID NO: 1 - DNA, 363 bp, Artificial Sequence
  Description of Artificial Sequence: Synthetic heavy chain variable region
caggtccagcttgtacagtctggggctgaggtgaagaagcctggggcctcagtgaaggtgtcctgcagggcttctggattcgtcttcaccagttatgatatcaactgggtgcgacaggccccggggcaaggtcttgagtggatggggcgaatgaacgctcacactggacaggtgacgtatgcccagaaattccaggacaaagtctccatgaccagggacgtctccataacgacagcctacctggaactgagtcgcctggcatctgaggacacggccgtctattactgtgcgaggcccgacattaactggggtcaagatgcttttgatgtctggggccagggcacaatggtcaccgtctcttca

SEQ ID NO: 2 - protein, 121 aa, Artificial Sequence
  Description of Artificial Sequence: Synthetic heavy chain variable region
QVQLVQSGAEVKKPGASVKVSCRASGFVFTSYDINWVRQAPGQGLEWMGRMNAHTGQVTYAQKFQDKVSMTRDVSITTAYLELSRLASEDTAVYYCARPDINWGQDAFDVWGQGTMVTVSS

SEQ ID NO: 3 - protein, 9 aa, Artificial Sequence
  Description of Artificial Sequence: Synthetic heavy chain variable region CDR H1
FVFTSYDIN

SEQ ID NO: 4 - DNA, 27 bp, Artificial Sequence
  Description of Artificial Sequence: Synthetic heavy chain variable region CDR H1
ttcgtcttcaccagttatgatatcaac

SEQ ID NO: 5 - protein, 17 aa, Artificial Sequence
  Description of Artificial Sequence: Synthetic heavy chain variable region CDR H2
RMNAHTGQVTYAQKFQD

SEQ ID NO: 6 - DNA, 51 bp, Artificial Sequence
  Description of Artificial Sequence: Synthetic heavy chain variable region CDR H2
cgaatgaacgctcacactggacaggtgacgtatgcccagaaattccaggac

SEQ ID NO: 7 - protein, 14 aa, Artificial Sequence
  Description of Artificial Sequence: Synthetic heavy chain variable region CDR H3
ARPDINWGQDAFDV

SEQ ID NO: 8 - DNA, 42 bp, Artificial Sequence
  Description of Artificial Sequence: Synthetic heavy chain variable region CDR H3
gcgaggcccgacattaactggggtcaagatgcttttgatgtc

SEQ ID NO: 9 - DNA, 318 bp, Artificial Sequence
  Description of Artificial Sequence: Synthetic light chain variable region
gacatccggatgacccagtctccttccaccctgtctgcatctataggagccagagtcaccatcacttgccgggccagtcagaatattggtaacttcttggcctggtatcagcagaagccagggaaagcccctaaactcctgatctataaggcgtctactttagatcctggggtcccatcaaggttcagcggcagcggatctgggacagaattcactctcaccatcaccagcctgcagcctgatgatttcgcaacattttactgccaacagtataagagtgaccccacttttggccaggggaccaaggtggaaatcaaa

SEQ ID NO: 10 - protein, 106 aa, Artificial Sequence
  Description of Artificial Sequence: Synthetic light chain variable region
DIRMTQSPSTLSASIGARVTITCRASQNIGNFLAWYQQKPGKAPKLLIYKASTLDPGVPSRFSGSGSGTEFTLTITSLQPDDFATFYCQQYKSDPTFGQGTKVEIK

SEQ ID NO: 11 - protein, 11 aa, Artificial Sequence
  Description of Artificial Sequence: Synthetic light chain variable region CDR L1
RASQNIGNFLA

SEQ ID NO: 12 - DNA, 33 bp, Artificial Sequence
  Description of Artificial Sequence: Synthetic light chain variable region CDR L1
cgggccagtcagaatattggtaacttcttggcc

SEQ ID NO: 13 - protein, 7 aa, Artificial Sequence
  Description of Artificial Sequence: Synthetic light chain variable region CDR L2
KASTLDP

SEQ ID NO: 14 - DNA, 21 bp, Artificial Sequence
  Description of Artificial Sequence: Synthetic light chain variable region CDR L2
aaggcgtctactttagatcct

SEQ ID NO: 15 - protein, 8 aa, Artificial Sequence
  Description of Artificial Sequence: Synthetic light chain variable region CDR L3
QQYKSDPT

SEQ ID NO: 16 - DNA, 24 bp, Artificial Sequence
  Description of Artificial Sequence: Synthetic light chain variable region CDR L3
caacagtataagagtgaccccact

SEQ ID NO: 17 - DNA, 384 bp, Artificial Sequence
  Description of Artificial Sequence: Synthetic heavy chain variable region
caggtccagctggtgcagtctggggctgaggtgaagaagcctgggtcatcggtgagggtctcctgtagggcttcaggagtcactttgaccaccgttgctgtcaactgggtgcgccaggtccctgggcaagggcctgagtggattggagggatcctcgttgggcttggtaaggtcagactcgcccagaaatttgagaatcgagccactctaagggcggacacatctagcaacacagcctacatggagttgagcggcctgagatttgaggacacggccgtctattattgtgcgataatcgacccccaagattgtactgctgccagctgcttttgggtcaactggctcgacccctggggccagggaaccctggtcaccgtctcctca

SEQ ID NO: 18 - protein, 128 aa, Artificial Sequence
  Description of Artificial Sequence: Synthetic heavy chain variable region
QVQLVQSGAEVKKPGSSVRVSCRASGVTLTTVAVNWVRQVPGQGPEWIGGILVGLGKVRLAQKFENRATLRADTSSNTAYMELSGLRFEDTAVYYCAIIDPQDCTAASCFWVNWLDPWGQGTLVTVSS

SEQ ID NO: 19 - protein, 9 aa, Artificial Sequence
  Description of Artificial Sequence: Synthetic heavy chain variable region CDR H1
VTLTTVAVN

SEQ ID NO: 20 - DNA, 27 bp, Artificial Sequence
  Description of Artificial Sequence: Synthetic heavy chain variable region CDR H1
gtcactttgaccaccgttgctgtcaac

SEQ ID NO: 21 - protein, 17 aa, Artificial Sequence
  Description of Artificial Sequence: Synthetic heavy chain variable region CDR H2
GILVGLGKVRLAQKFEN

SEQ ID NO: 22 - DNA, 51 bp, Artificial Sequence
  Description of Artificial Sequence: Synthetic heavy chain variable region CDR H2
gggatcctcgttgggcttggtaaggtcagactcgcccagaaatttgagaat

SEQ ID NO: 23 - protein, 21 aa, Artificial Sequence
  Description of Artificial Sequence: Synthetic heavy chain variable region CDR H3
AIIDPQDCTAASCFWVNWLDP

SEQ ID NO: 24 - DNA, 63 bp, Artificial Sequence
  Description of Artificial Sequence: Synthetic heavy chain variable region CDR H3
gcgataatcgacccccaagattgtactgctgccagctgcttttgggtcaactggctcgacccc

SEQ ID NO: 25 - DNA, 324 bp, Artificial Sequence
  Description of Artificial Sequence: Synthetic light chain variable region
gaaattgtattgacgcagtctccaggcaccctgaccttgtctccaggggagacagccaccctctcctgcagggccagtcagagtgttcttagtggctacttagcctggtaccagcagaaacctggccaggctcccaggctcctcatctatgctgcatccactagggccactgacatcccagcgaggttcactggcagtgggtctgcgacagacttcactctcaccatcagcagactggagcctcaagattttgcagtgtattactgtcagcagtatggttcggctccgatcaccttcggccaagggacacgactggagattaaa

SEQ ID NO: 26 - protein, 108 aa, Artificial Sequence
  Description of Artificial Sequence: Synthetic light chain variable region
EIVLTQSPGTLTLSPGETATLSCRASQSVLSGYLAWYQQKPGQAPRLLIYAASTRATDIPARFTGSGSATDFTLTISRLEPQDFAVYYCQQYGSAPITFGQGTRLEIK

SEQ ID NO: 27 - protein, 12 aa, Artificial Sequence
  Description of Artificial Sequence: Synthetic light chain variable region CDR L1
RASQSVLSGYLA

SEQ ID NO: 28 - DNA, 36 bp, Artificial Sequence
  Description of Artificial Sequence: Synthetic light chain variable region CDR L1
agggccagtcagagtgttcttagtggctacttagcc

SEQ ID NO: 29 - protein, 7 aa, Artificial Sequence
  Description of Artificial Sequence: Synthetic light chain variable region CDR L2
AASTRAT

SEQ ID NO: 30 - DNA, 21 bp, Artificial Sequence
  Description of Artificial Sequence: Synthetic light chain variable region CDR L2
gctgcatccactagggccact

SEQ ID NO: 31 - protein, 9 aa, Artificial Sequence
  Description of Artificial Sequence: Synthetic light chain variable region CDR L3
QQYGSAPIT

SEQ ID NO: 32 - DNA, 27 bp, Artificial Sequence
  Description of Artificial Sequence: Synthetic light chain variable region CDR L3
cagcagtatggttcggctccgatcacc

SEQ ID NO: 33 - DNA, 384 bp, Artificial Sequence
  Description of Artificial Sequence: Synthetic heavy chain variable region
caggtccagctggtgcagtctggggctgaggtaaagaagcctgggtcatcggtgaaggtctcctgcaaggcctctggaggcaccatcaacaacgttgctatcagttggctgcgacaggcccctggacaaggcctggagtggctgggagggaacatccctggctttggtaaagtcagatactcacagcagtttgagaccagactcactttaaccgcggacgtctcgtccgacacagcctacatggtgttgaccagcctaagatctgaagacacggccgtctattactgtgcgatcatcgacccccaactttgcaccagagccagctgcttttgggtcaactggctcgacccctggggccaggggaccacggtcaccgtctcctca

SEQ ID NO: 34 - protein, 128 aa, Artificial Sequence
  Description of Artificial Sequence: Synthetic heavy chain variable region
QVQLVQSGAEVKKPGSSVKVSCKASGGTINNVAISWLRQAPGQGLEWLGGNIPGFGKVRYSQQFETRLTLTADVSSDTAYMVLTSLRSEDTAVYYCAIIDPQLCTRASCFWVNWLDPWGQGTTVTVSS

SEQ ID NO: 35 - protein, 9 aa, Artificial Sequence
  Description of Artificial Sequence: Synthetic heavy chain variable region CDR H1
GTINNVAIS

SEQ ID NO: 36 - DNA, 27 bp, Artificial Sequence
  Description of Artificial Sequence: Synthetic heavy chain variable region CDR H1
ggcaccatcaacaacgttgctatcagt

SEQ ID NO: 37 - protein, 17 aa, Artificial Sequence
  Description of Artificial Sequence: Synthetic heavy chain variable region CDR H2
GNIPGFGKVRYSQQFET

SEQ ID NO: 38 - DNA, 51 bp, Artificial Sequence
  Description of Artificial Sequence: Synthetic heavy chain variable region CDR H2
gggaacatccctggctttggtaaagtcagatactcacagcagtttgagacc

SEQ ID NO: 39 - protein, 21 aa, Artificial Sequence
  Description of Artificial Sequence: Synthetic heavy chain variable region CDR H3
AIIDPQLCTRASCFWVNWLDP

SEQ ID NO: 40 - DNA, 63 bp, Artificial Sequence
  Description of Artificial Sequence: Synthetic heavy chain variable region CDR H3
gcgatcatcgacccccaactttgcaccagagccagctgcttttgggtcaactggctcgacccc

SEQ ID NO: 41 - DNA, 324 bp, Artificial Sequence
  Description of Artificial Sequence: Synthetic light chain variable region
gatattgtgatgactcagtctccaggcaccctgtctgtgtctccaggggagagtgccgccctctcctgcggggccagtgagagtattctcagcgactccttagcctggtaccagcataaacctggtcaggctcccaggctcctcatctatggtgcatccagtagggccgctggcatcccagacaggttcagtggcagtgggtctgggacagacttcactctcaccatcagcagactggagccagaggattttgcagtgtatttctgtcaacagtttggtgccttaccgatcactttcggccaagggacacgactggagattaaa

SEQ ID NO: 42 - protein, 108 aa, Artificial Sequence
  Description of Artificial Sequence: Synthetic light chain variable region
DIVMTQSPGTLSVSPGESAALSCGASESILSDSLAWYQHKPGQAPRLLIYGASSRAAGIPDRFSGSGSGTDFTLTISRLEPEDFAVYFCQQFGALPITFGQGTRLEIK

SEQ ID NO: 43 - protein, 12 aa, Artificial Sequence
  Description of Artificial Sequence: Synthetic light chain variable region CDR L1
GASESILSDSLA

SEQ ID NO: 44 - DNA, 36 bp, Artificial Sequence
  Description of Artificial Sequence: Synthetic light chain variable region CDR L1
ggggccagtgagagtattctcagcgactccttagcc

SEQ ID NO: 45 - protein, 7 aa, Artificial Sequence
  Description of Artificial Sequence: Synthetic light chain variable region CDR L2
GASSRAA

SEQ ID NO: 46 - DNA, 21 bp, Artificial Sequence
  Description of Artificial Sequence: Synthetic light chain variable region CDR L2
ggtgcatccagtagggccgct

SEQ ID NO: 47 - protein, 9 aa, Artificial Sequence
  Description of Artificial Sequence: Synthetic light chain variable region CDR L3
QQFGALPIT

SEQ ID NO: 48 - DNA, 27 bp, Artificial Sequence
  Description of Artificial Sequence: Synthetic light chain variable region CDR L3
caacagtttggtgccttaccgatcact

SEQ ID NO: 49 - DNA, 363 bp, Artificial Sequence
  Description of Artificial Sequence: Synthetic heavy chain variable region
caggtgcagctggtgcaatctggggctgaggtgaagaagccggggtcctcggtgaaaatctcctgtaaggcttctggaggcaccttcaacagtcaagcaattcactgggtgcgacaggcccctggacaagaccttgagtggatgggaaacatcatccctgggttcggatcaccaaactccgcgcagaacttccagggcagggtcaccttcattgcggacgattccactggcgctgcctacatggacttgagtagcctgaagtctgaagacacggccgtctattactgtgcgacagccgggtggttcggggaatcagttcatttggactcatggggccagggaaccctggtcaccgtctcctca

SEQ ID NO: 50 - protein, 121 aa, Artificial Sequence
  Description of Artificial Sequence: Synthetic heavy chain variable region
QVQLVQSGAEVKKPGSSVKISCKASGGTFNSQAIHWVRQAPGQDLEWMGNIIPGFGSPNSAQNFQGRVTFIADDSTGAAYMDLSSLKSEDTAVYYCATAGWFGESVHLDSWGQGTLVTVSS

SEQ ID NO: 51 - protein, 9 aa, Artificial Sequence
  Description of Artificial Sequence: Synthetic heavy chain variable region CDR H1
GTFNSQAIH

SEQ ID NO: 52 - DNA, 27 bp, Artificial Sequence
  Description of Artificial Sequence: Synthetic heavy chain variable region CDR H1
ggcaccttcaacagtcaagcaattcac

SEQ ID NO: 53 - protein, 17 aa, Artificial Sequence
  Description of Artificial Sequence: Synthetic heavy chain variable region CDR H2
NIIPGFGSPNSAQNFQG

SEQ ID NO: 54 - DNA, 51 bp, Artificial Sequence
  Description of Artificial Sequence: Synthetic heavy chain variable region CDR H2
aacatcatccctgggttcggatcaccaaactccgcgcagaacttccagggc

SEQ ID NO: 55 - protein, 14 aa, Artificial Sequence
  Description of Artificial Sequence: Synthetic heavy chain variable region CDR H3
ATAGWFGESVHLDS

SEQ ID NO: 56 - DNA, 42 bp, Artificial Sequence
  Description of Artificial Sequence: Synthetic heavy chain variable region CDR H3
gcgacagccgggtggttcggggaatcagttcatttggactca

SEQ ID NO: 57 - DNA, 324 bp, Artificial Sequence
  Description of Artificial Sequence: Synthetic light chain variable region
gatattgtgatgactcagtctccagccaccctgtctgtgtctccaggggaaagagccaccctctcctgcagggccagtgagagtgttagcagcaacttagcctggtaccagcagaaacctggccaggctcccaggctcctcatctatggtgcatccaccagggccactggtatcccagccaggttcagtggcagtgggtcagggacggagttcactctcaccatcaacagcctgcagtctgaagattttgcagtttattactgtcagcagtataataactggcctcctctcactttcggcggagggaccaaggtggaaatcaaa

SEQ ID NO: 58 - protein, 108 aa, Artificial Sequence
  Description of Artificial Sequence: Synthetic light chain variable region
DIVMTQSPATLSVSPGERATLSCRASESVSSNLAWYQQKPGQAPRLLIYGASTRATGIPARFSGSGSGTEFTLTINSLQSEDFAVYYCQQYNNWPPLTFGGGTKVEIK

SEQ ID NO: 59 - protein, 11 aa, Artificial Sequence
  Description of Artificial Sequence: Synthetic light chain variable region CDR L1
RASESVSSNLA

SEQ ID NO: 60 - DNA, 33 bp, Artificial Sequence
  Description of Artificial Sequence: Synthetic light chain variable region CDR L1
agggccagtgagagtgttagcagcaacttagcc

SEQ ID NO: 61 - protein, 7 aa, Artificial Sequence
  Description of Artificial Sequence: Synthetic light chain variable region CDR L2
GASTRAT

SEQ ID NO: 62 - DNA, 21 bp, Artificial Sequence
  Description of Artificial Sequence: Synthetic light chain variable region CDR L2
ggtgcatccaccagggccact

SEQ ID NO: 63 - protein, 10 aa, Artificial Sequence
  Description of Artificial Sequence: Synthetic light chain variable region CDR L3
QQYNNWPPLT

SEQ ID NO: 64 - DNA, 30 bp, Artificial Sequence
  Description of Artificial Sequence: Synthetic light chain variable region CDR L3
cagcagtataataactggcctcctctcact

SEQ ID NO: 65 - DNA, 363 bp, Artificial Sequence
  Description of Artificial Sequence: Synthetic heavy chain variable region
caggtccagctggtacagtctggaagtgaggtgaagaagcctggggcctcggtgaaggtctcctgcaaggcctcaggttacaggttttccaactatggtatcagctgggtgcgacaggcccctggacaaggcctagagtggatgggatggatcagcgcttacaatggaaacataaagtatggaaataacctccagggcagagtcaccgtgaccacagacacatccacggccacggcctacatggaggtgaggagcctgacatctgacgacacggccgtgtattactgtgcgagagatgtcccagctgacggggtccacttcatggacgtctggggccaaggaaccctggtcaccgtctcctca

SEQ ID NO: 66 - protein, 121 aa, Artificial Sequence
  Description of Artificial Sequence: Synthetic heavy chain variable region
QVQLVQSGSEVKKPGASVKVSCKASGYRFSNYGISWVRQAPGQGLEWMGWISAYNGNIKYGNNLQGRVTVTTDTSTATAYMEVRSLTSDDTAVYYCARDVPADGVHFMDVWGQGTLVTVSS

SEQ ID NO: 67 - protein, 9 aa, Artificial Sequence
  Description of Artificial Sequence: Synthetic heavy chain variable region CDR H1
YRFSNYGIS

SEQ ID NO: 68 - DNA, 27 bp, Artificial Sequence
  Description of Artificial Sequence: Synthetic heavy chain variable region CDR H1
tacaggttttccaactatggtatcagc

SEQ ID NO: 69 - protein, 17 aa, Artificial Sequence
  Description of Artificial Sequence: Synthetic heavy chain variable region CDR H2
WISAYNGNIKYGNNLQG

SEQ ID NO: 70 - DNA, 51 bp, Artificial Sequence
  Description of Artificial Sequence: Synthetic heavy chain variable region CDR H2
tggatcagcgcttacaatggaaacataaagtatggaaataacctccagggc

SEQ ID NO: 71 - protein, 14 aa, Artificial Sequence
  Description of Artificial Sequence: Synthetic heavy chain variable region CDR H3
ARDVPADGVHFMDV

SEQ ID NO: 72 - DNA, 42 bp, Artificial Sequence
  Description of Artificial Sequence: Synthetic heavy chain variable region CDR H3
gcgagagatgtcccagctgacggggtccacttcatggacgtc

SEQ ID NO: 73 - DNA, 336 bp, Artificial Sequence
  Description of Artificial Sequence: Synthetic light chain variable region
gaaattgtaatgacacagtctccactctccctgcccgtcacccttggacagccggcctccatctcctgcaggtctagtcaaagcctcgtacacagtgatactaacacctacttgaactggtttcagcagaggccaggccaatctccacggcgcctaatttataaggtttctaaccgggactctggggtcccagacagattcagcggcagtgggtcaggcactactttcacactgaaaatcagcagggtggaggctgaggatgttgggatttattactgcatgcagggttcacactgggctccgactttcggccaggggaccaaggtggaaatcaaa

SEQ ID NO: 74 - protein, 112 aa, Artificial Sequence
  Description of Artificial Sequence: Synthetic light chain variable region
EIVMTQSPLSLPVTLGQPASISCRSSQSLVHSDTNTYLNWFQQRPGQSPRRLIYKVSNRDSGVPDRFSGSGSGTTFTLKISRVEAEDVGIYYCMQGSHWAPTFGQGTKVEIK

SEQ ID NO: 75 - protein, 16 aa, Artificial Sequence
  Description of Artificial Sequence: Synthetic light chain variable region CDR L1
RSSQSLVHSDTNTYLN

SEQ ID NO: 76 - DNA, 48 bp, Artificial Sequence
  Description of Artificial Sequence: Synthetic light chain variable region CDR L1
aggtctagtcaaagcctcgtacacagtgatactaacacctacttgaac

SEQ ID NO: 77 - protein, 7 aa, Artificial Sequence
  Description of Artificial Sequence: Synthetic light chain variable region CDR L2
KVSNRDS

SEQ ID NO: 78 - DNA, 21 bp, Artificial Sequence
  Description of Artificial Sequence: Synthetic light chain variable region CDR L2
aaggtttctaaccgggactct

SEQ ID NO: 79 - protein, 9 aa, Artificial Sequence
  Description of Artificial Sequence: Synthetic light chain variable region CDR L3
MQGSHWAPT

SEQ ID NO: 80 - DNA, 27 bp, Artificial Sequence
  Description of Artificial Sequence: Synthetic light chain variable region CDR L3
atgcagggttcacactgggctccgact

SEQ ID NO: 81 - DNA, 378 bp, Artificial Sequence
  Description of Artificial Sequence: Synthetic heavy chain variable region
caggtccagctggtgcagtctgggactgaggtgaagaagcctgggtcctcggtgaaggtctcctgcaaggcttctggaggcaccttcggcagctacgctgtcatctgggtgcgacaggcccctggacaagggcttgaatggatgggacatttcatccctgtgtttgctacaacaaacaaggcacagaagttccagggcagactcacccttagtacagacgaatctacgggcacagtctacatggagctgagcagcctgagatctgaggacacggccgtctatttctgtgcgaccaagagatattgtagtgatcccagctgccatggactctggtacttcgatctctggggccgtggcaccctggtcactgtctcctca

SEQ ID NO: 82 - protein, 126 aa, Artificial Sequence
  Description of Artificial Sequence: Synthetic heavy chain variable region
QVQLVQSGTEVKKPGSSVKVSCKASGGTFGSYAVIWVRQAPGQGLEWMGHFIPVFATTNKAQKFQGRLTLSTDESTGTVYMELSSLRSEDTAVYFCATKRYCSDPSCHGLWYFDLWGRGTLVTVSS

SEQ ID NO: 83 - protein, 9 aa, Artificial Sequence
  Description of Artificial Sequence: Synthetic heavy chain variable region CDR H1
GTFGSYAVI

SEQ ID NO: 84 - DNA, 27 bp, Artificial Sequence
  Description of Artificial Sequence: Synthetic heavy chain variable region CDR H1
ggcaccttcggcagctacgctgtcatc

SEQ ID NO: 85 - protein, 17 aa, Artificial Sequence
  Description of Artificial Sequence: Synthetic heavy chain variable region CDR H2
HFIPVFATTNKAQKFQG

SEQ ID NO: 86 - DNA, 51 bp, Artificial Sequence
  Description of Artificial Sequence: Synthetic heavy chain variable region CDR H2
catttcatccctgtgtttgctacaacaaacaaggcacagaagttccagggc

SEQ ID NO: 87 - protein, 19 aa, Artificial Sequence
  Description of Artificial Sequence: Synthetic heavy chain variable region CDR H3
ATKRYCSDPSCHGLWYFDL

SEQ ID NO: 88 - DNA, 57 bp, Artificial Sequence
  Description of Artificial Sequence: Synthetic heavy chain variable region CDR H3
gcgaccaagagatattgtagtgatcccagctgccatggactctggtacttcgatctc

SEQ ID NO: 89 - DNA, 339 bp, Artificial Sequence
  Description of Artificial Sequence: Synthetic light chain variable region
gacatccagttgacccagtctccactctccctgcccgtcacccctggagagccggcctccatctcctgcaggtctagtcagagcctcttggatagtgatgatggaaacacctatttggactggtacctgcagaagccagggcagtctccacaggtcctgatctatatgctttcgtatcgggcctctggagtcccagacaggttcagtggcagtgggtcaggcactgatttcacactagaaatcagcagggtggaggctgaggatgttggagtttattactgcatgcaacgtgtagagtttccttacacttttggccaggggaccaagctggagatcaaa

SEQ ID NO: 90 - protein, 113 aa, Artificial Sequence
  Description of Artificial Sequence: Synthetic light chain variable region
DIQLTQSPLSLPVTPGEPASISCRSSQSLLDSDDGNTYLDWYLQKPGQSPQVLIYMLSYRASGVPDRFSGSGSGTDFTLEISRVEAEDVGVYYCMQRVEFPYTFGQGTKLEIK

SEQ ID NO: 91 - protein, 17 aa, Artificial Sequence
  Description of Artificial Sequence: Synthetic light chain variable region CDR L1
RSSQSLLDSDDGNTYLD

SEQ ID NO: 92 - DNA, 51 bp, Artificial Sequence
  Description of Artificial Sequence: Synthetic light chain variable region CDR L1
aggtctagtcagagcctcttggatagtgatgatggaaacacctatttggac

SEQ ID NO: 93 - protein, 7 aa, Artificial Sequence
  Description of Artificial Sequence: Synthetic light chain variable region CDR L2
MLSYRAS

SEQ ID NO: 94 - DNA, 21 bp, Artificial Sequence
  Description of Artificial Sequence: Synthetic light chain variable region CDR L2
atgctttcgtatcgggcctct

SEQ ID NO: 95 - protein, 9 aa, Artificial Sequence
  Description of Artificial Sequence: Synthetic light chain variable region CDR L3
MQRVEFPYT

SEQ ID NO: 96 - DNA, 27 bp, Artificial Sequence
  Description of Artificial Sequence: Synthetic light chain variable region CDR L3
atgcaacgtgtagagtttccttacact

SEQ ID NO: 97 - DNA, 345 bp, Artificial Sequence
  Description of Artificial Sequence: Synthetic heavy chain variable region
caggtccagctggtgcagtctgggcctgacgtgaagagacctggggcctcagtgagagtctcctgcaaggcttctggatacaccttcagcgactactatatgcactgggtgcgacaggcccctggacagggtcttgaatggctggcttgggtcaaccctagcactggcgccacacactactcagagagttttcggggctctatggtcgttcaaagggacacgtccaccgacacagcctacctggagctgagtagtctgaaatctgacgacacggccgtctattattgtgcgagaatcgggagtaatgagatttggggccaggggacaatggtcaccgtctcttca

SEQ ID NO: 98 - protein, 115 aa, Artificial Sequence
  Description of Artificial Sequence: Synthetic heavy chain variable region
QVQLVQSGPDVKRPGASVRVSCKASGYTFSDYYMHWVRQAPGQGLEWLAWVNPSTGATHYSESFRGSMVVQRDTSTDTAYLELSSLKSDDTAVYYCARIGSNEIWGQGTMVTVSS

SEQ ID NO: 99 - protein, 9 aa, Artificial Sequence
  Description of Artificial Sequence: Synthetic heavy chain variable region CDR H1
YTFSDYYMH

SEQ ID NO: 100 - DNA, 27 bp, Artificial Sequence
  Description of Artificial Sequence: Synthetic heavy chain variable region CDR H1
tacaccttcagcgactactatatgcac

SEQ ID NO: 101 - protein, 17 aa, Artificial Sequence
  Description of Artificial Sequence: Synthetic heavy chain variable region CDR H2
WVNPSTGATHYSESFRG

SEQ ID NO: 102 - DNA, 51 bp, Artificial Sequence
  Description of Artificial Sequence: Synthetic heavy chain variable region CDR H2
tgggtcaaccctagcactggcgccacacactactcagagagttttcggggc

SEQ ID NO: 103 - protein, 8 aa, Artificial Sequence
  Description of Artificial Sequence: Synthetic heavy chain variable region CDR H3
ARIGSNEI

SEQ ID NO: 104 - DNA, 24 bp, Artificial Sequence
  Description of Artificial Sequence: Synthetic heavy chain variable region CDR H3
gcgagaatcgggagtaatgagatt

SEQ ID NO: 105 - DNA, 330 bp, Artificial Sequence
  Description of Artificial Sequence: Synthetic light chain variable region
cagtctgccctgactcagcctgcctccgtgtctgggtctcctggacagtcgatcaccatctcctgcgctggcacttccagtgacattggtggttggaactatgtctcctggtaccaacagtaccccggccaagtccccaaactcatcctttatgaagtcactgataggccctcaggggtttctcatcgcttctctggctccaagtctggcaacagggccttccttaccatcactgggctccgggccgaggacgaggctgattattactgctgctcatttacttcttccggcagtagggttttcggcggagggaccaaggtcaccgtccta

SEQ ID NO: 106 - protein, 110 aa, Artificial Sequence
  Description of Artificial Sequence: Synthetic light chain variable region
QSALTQPASVSGSPGQSITISCAGTSSDIGGWNYVSWYQQYPGQVPKLILYEVTDRPSGVSHRFSGSKSGNRAFLTITGLRAEDEADYYCCSFTSSGSRVFGGGTKVTVL

SEQ ID NO: 107 - protein, 14 aa, Artificial Sequence
  Description of Artificial Sequence: Synthetic light chain variable region CDR L1
AGTSSDIGGWNYVS

SEQ ID NO: 108 - DNA, 42 bp, Artificial Sequence
  Description of Artificial Sequence: Synthetic light chain variable region CDR L1
gctggcacttccagtgacattggtggttggaactatgtctcc

SEQ ID NO: 109 - protein, 7 aa, Artificial Sequence
  Description of Artificial Sequence: Synthetic light chain variable region CDR L2
EVTDRPS

SEQ ID NO: 110 - DNA, 21 bp, Artificial Sequence
  Description of Artificial Sequence: Synthetic light chain variable region CDR L2
gaagtcactgataggccctca

SEQ ID NO: 111 - protein, 10 aa, Artificial Sequence
  Description of Artificial Sequence: Synthetic light chain variable region CDR L3
CSFTSSGSRV

SEQ ID NO: 112 - DNA, 30 bp, Artificial Sequence
  Description of Artificial Sequence: Synthetic light chain variable region CDR L3
tgctcatttacttcttccggcagtagggtt

SEQ ID NO: 113 - DNA, 384 bp, Artificial Sequence
  Description of Artificial Sequence: Synthetic heavy chain variable region
gaggtgcagctgttggagtctggggctgtgatgaagaggcctgggtcatcggtgagggtctcctgcagggcttcaggagtcactttgaccaccgtttctgtcaactgggtgcgccaggtccctgggcaagggcctgagtggattggagggatcctcattgggtttggtaaggtcagacaagcccagaaatttgagaaccgagtcactctgaccgcggacgcatcaaggaacacagcatatatggagttgagcggactgacatctgacgacacggccgtctattactgtgcgataatcgacccccaagattgtactcgtgccagctgcttttgggtcaactggctcgacccctggggccagggaaccctggtcaccgtctcctca

SEQ ID NO: 114 - protein, 128 aa, Artificial Sequence
  Description of Artificial Sequence: Synthetic heavy chain variable region
EVQLLESGAVMKRPGSSVRVSCRASGVTLTTVSVNWVRQVPGQGPEWIGGILIGFGKVRQAQKFENRVTLTADASRNTAYMELSGLTSDDTAVYYCAIIDPQDCTRASCFWVNWLDPWGQGTLVTVSS

SEQ ID NO: 115 - protein, 9 aa, Artificial Sequence
  Description of Artificial Sequence: Synthetic heavy chain variable region CDR H1
VTLTTVSVN

SEQ ID NO: 116 - DNA, 27 bp, Artificial Sequence
  Description of Artificial Sequence: Synthetic heavy chain variable region CDR H1
gtcactttgaccaccgtttctgtcaac

SEQ ID NO: 117 - protein, 17 aa, Artificial Sequence
  Description of Artificial Sequence: Synthetic heavy chain variable region CDR H2
GILIGFGKVRQAQKFEN

SEQ ID NO: 118 - DNA, 51 bp, Artificial Sequence
  Description of Artificial Sequence: Synthetic heavy chain variable region CDR H2
gggatcctcattgggtttggtaaggtcagacaagcccagaaatttgagaac

SEQ ID NO: 119 - protein, 21 aa, Artificial Sequence
  Description of Artificial Sequence: Synthetic heavy chain variable region CDR H3
AIIDPQDCTRASCFWVNWLDP

SEQ ID NO: 120 - DNA, 63 bp, Artificial Sequence
  Description of Artificial Sequence: Synthetic heavy chain variable region CDR H3
gcgataatcgacccccaagattgtactcgtgccagctgcttttgggtcaactggctcgacccc

SEQ ID NO: 121 - DNA, 324 bp, Artificial Sequence
  Description of Artificial Sequence: Synthetic light chain variable region
gacatccggatgacccagtctccaggcaccctgaccttgtccccaggggagcgagccaccctctcctgcagggccagtcagagtattcttagcgggaacttagcctggtaccagcagaaacctggccaggctcccaggctcctcatctctgctgcatccactagggccactgacatcccagacaggttcagtggcagtgggtctgggacagacttcactctcaccatcaccagactggagcctcaagattttgcagtgtattactgtcagcagtatgattcggctccgatcaccttcggccaagggacacgactggagattaaa

SEQ ID NO: 122 - protein, 108 aa, Artificial Sequence
  Description of Artificial Sequence: Synthetic light chain variable region
DIRMTQSPGTLTLSPGERATLSCRASQSILSGNLAWYQQKPGQAPRLLISAASTRATDIPDRFSGSGSGTDFTLTITRLEPQDFAVYYCQQYDSAPITFGQGTRLEIK

SEQ ID NO: 123 - protein, 12 aa, Artificial Sequence
  Description of Artificial Sequence: Synthetic light chain variable region CDR L1
RASQSILSGNLA

SEQ ID NO: 124 - DNA, 36 bp, Artificial Sequence
  Description of Artificial Sequence: Synthetic light chain variable region CDR L1
agggccagtcagagtattcttagcgggaacttagcc

SEQ ID NO: 125 - protein, 7 aa, Artificial Sequence
  Description of Artificial Sequence: Synthetic light chain variable region CDR L2
AASTRAT

SEQ ID NO: 126 - DNA, 21 bp, Artificial Sequence
  Description of Artificial Sequence: Synthetic light chain variable region CDR L2
gctgcatccactagggccact

SEQ ID NO: 127 - protein, 9 aa, Artificial Sequence
  Description of Artificial Sequence: Synthetic light chain variable region CDR L3
QQYDSAPIT

SEQ ID NO: 128 - DNA, 27 bp, Artificial Sequence
  Description of Artificial Sequence: Synthetic light chain variable region CDR L3
cagcagtatgattcggctccgatcacc

SEQ ID NO: 129 - DNA, 378 bp, Artificial Sequence
  Description of Artificial Sequence: Synthetic heavy chain variable region
caggtccagcttgtgcagtctggggctgaggtgaagaagcctgggtcctcggtgaaggtctcctgcgaggcttctggagacaccttcaccagttatgcagtcatctgggtgcgccagaccccaggacaagggcttgagttcatgggaagtatcatccctatctttcaaacaataaactacgctccgaagttccaggggagggtcaccctaagcgcggacggatccacgagcacagtcttcatggagttgcgaaacctgagatctgaggacacggccatatatttctgtgcgaccaagagatattgtactagtcccagctgccatggactctggtacttcaatctctggggccgtggcacaatggtcaccgtctcttca

SEQ ID NO: 130 - protein, 126 aa, Artificial Sequence
  Description of Artificial Sequence: Synthetic heavy chain variable region
QVQLVQSGAEVKKPGSSVKVSCEASGDTFTSYAVIWVRQTPGQGLEFMGSIIPIFQTINYAPKFQGRVTLSADGSTSTVFMELRNLRSEDTAIYFCATKRYCTSPSCHGLWYFNLWGRGTMVTVSS

SEQ ID NO: 131 - protein, 9 aa, Artificial Sequence
  Description of Artificial Sequence: Synthetic heavy chain variable region CDR H1
DTFTSYAVI

SEQ ID NO: 132 - DNA, 27 bp, Artificial Sequence
  Description of Artificial Sequence: Synthetic heavy chain variable region CDR H1
gacaccttcaccagttatgcagtcatc

SEQ ID NO: 133 - protein, 17 aa, Artificial Sequence
  Description of Artificial Sequence: Synthetic heavy chain variable region CDR H2
SIIPIFQTINYAPKFQG

SEQ ID NO: 134 - DNA, 51 bp, Artificial Sequence
  Description of Artificial Sequence: Synthetic heavy chain variable region CDR H2
agtatcatccctatctttcaaacaataaactacgctccgaagttccagggg

SEQ ID NO: 135 - protein, 19 aa, Artificial Sequence
  Description of Artificial Sequence: Synthetic heavy chain variable region CDR H3
ATKRYCTSPSCHGLWYFNL

SEQ ID NO: 136 - DNA, 57 bp, Artificial Sequence
  Description of Artificial Sequence: Synthetic heavy chain variable region CDR H3
gcgaccaagagatattgtactagtcccagctgccatggactctggtacttcaatctc

SEQ ID NO: 137 - DNA, 339 bp, Artificial Sequence
  Description of Artificial Sequence: Synthetic light chain variable region
gaaacgacactcacgcagtctccaatctccctgtccgtcacccctggagagccggcctccatctcctgcaggtctagtaagagcctcttggatagtgatgatggaaacacttatttggactggtacctgcagaagccagggcagtctccacagatcctgatctatatgctttcgtatcgggcctctggagtcccagacaggttcagtggcagtgggtcaggcactgatttcacactgaaaatcagcagggtggaggctgaggatgttggagtttattactgcatgcaacgtatagagtatccttacacttttggccaggggaccaaggtggagatcaaa

SEQ ID NO: 138 - protein, 113 aa, Artificial Sequence
  Description of Artificial Sequence: Synthetic light chain variable region
ETTLTQSPISLSVTPGEPASISCRSSKSLLDSDDGNTYLDWYLQKPGQSPQILIYMLSYRASGVPDRFSGSGSGTDFTLKISRVEAEDVGVYYCMQRIEYPYTFGQGTKVEIK

SEQ ID NO: 139 - protein, 17 aa, Artificial Sequence
  Description of Artificial Sequence: Synthetic light chain variable region CDR L1
RSSKSLLDSDDGNTYLD

SEQ ID NO: 140 - DNA, 51 bp, Artificial Sequence
  Description of Artificial Sequence: Synthetic light chain variable region CDR L1
aggtctagtaagagcctcttggatagtgatgatggaaacacttatttggac

SEQ ID NO: 141 - protein, 7 aa, Artificial Sequence
  Description of Artificial Sequence: Synthetic light chain variable region CDR L2
MLSYRAS

SEQ ID NO: 142 - DNA, 21 bp, Artificial Sequence
  Description of Artificial Sequence: Synthetic light chain variable region CDR L2
atgctttcgtatcgggcctct

SEQ ID NO: 143 - protein, 9 aa, Artificial Sequence
  Description of Artificial Sequence: Synthetic light chain variable region CDR L3
MQRIEYPYT

SEQ ID NO: 144 - DNA, 27 bp, Artificial Sequence
  Description of Artificial Sequence: Synthetic light chain variable region CDR L3
atgcaacgtatagagtatccttacact

SEQ ID NO: 145 - DNA, 363 bp, Artificial Sequence
  Description of Artificial Sequence: Synthetic heavy chain variable region
caggtgcagctggtgcaatctggggctgagatgaagaagcctgggtcctcggtgacagtctcctgcaaggcttctggagtccccttcaccagttatacctacagctgggtgcgacaggcccctggacaagggcttgagtggatgggaagggtcctccctgtcataggttcggcaaagtacccacagaagttccagggcacagtcaccattaccgcggacaaatccacgagcacaatatatttgcaactgagcagcctaagacctgaagacacggccatttatttctgtgcgggaagtctactggctgggtacgacagggaatttgactcctggggccagggaaccctggtcaccgtctcctca

SEQ ID NO: 146 - protein, 121 aa, Artificial Sequence
  Description of Artificial Sequence: Synthetic heavy chain variable region
QVQLVQSGAEMKKPGSSVTVSCKASGVPFTSYTYSWVRQAPGQGLEWMGRVLPVIGSAKYPQKFQGTVTITADKSTSTIYLQLSSLRPEDTAIYFCAGSLLAGYDREFDSWGQGTLVTVSS

SEQ ID NO: 147 - protein, 9 aa, Artificial Sequence
  Description of Artificial Sequence: Synthetic heavy chain variable region CDR H1
VPFTSYTYS

SEQ ID NO: 148 - DNA, 27 bp, Artificial Sequence
  Description of Artificial Sequence: Synthetic heavy chain variable region CDR H1
gtccccttcaccagttatacctacagc

SEQ ID NO: 149 - protein, 17 aa, Artificial Sequence
  Description of Artificial Sequence: Synthetic heavy chain variable region CDR H2
RVLPVIGSAKYPQKFQG

SEQ ID NO: 150 - DNA, 51 bp, Artificial Sequence
  Description of Artificial Sequence: Synthetic heavy chain variable region CDR H2
agggtcctccctgtcataggttcggcaaagtacccacagaagttccagggc

SEQ ID NO: 151 - protein, 14 aa, Artificial Sequence
  Description of Artificial Sequence: Synthetic heavy chain variable region CDR H3
AGSLLAGYDREFDS

SEQ ID NO: 152 - DNA, 42 bp, Artificial Sequence
  Description of Artificial Sequence: Synthetic heavy chain variable region CDR H3
gcgggaagtctactggctgggtacgacagggaatttgactcc

SEQ ID NO: 153 - DNA, 321 bp, Artificial Sequence
  Description of Artificial Sequence: Synthetic light chain variable region
gacatccagatgacccagtctccatcctcactgtctgcatctgtgggagacagaatcaccatcacttgtcgggcgagtcagggtattagcaactggttagcctggtatcagcagaagccagggaaagcccctaagtccctgatctatgaagcatccactttgcaaagtggggtttcatcaaggttcagcggcagtggatctgggacacacttcactctcaccatcgccagcctgcagcctgaagattttgcaacttattactgccaacagtattatatttacccgctcactttcggcggagggaccaagctggagatcaaa

SEQ ID NO: 154 - protein, 107 aa, Artificial Sequence
  Description of Artificial Sequence: Synthetic light chain variable region
DIQMTQSPSSLSASVGDRITITCRASQGISNWLAWYQQKPGKAPKSLIYEASTLQSGVSSRFSGSGSGTHFTLTIASLQPEDFATYYCQQYYIYPLTFGGGTKLEIK

SEQ ID NO: 155 - protein, 11 aa, Artificial Sequence
  Description of Artificial Sequence: Synthetic light chain variable region CDR L1
RASQGISNWLA

SEQ ID NO: 156 - DNA, 33 bp, Artificial Sequence
  Description of Artificial Sequence: Synthetic light chain variable region CDR L1
cgggcgagtcagggtattagcaactggttagcc

SEQ ID NO: 157 - protein, 7 aa, Artificial Sequence
  Description of Artificial Sequence: Synthetic light chain variable region CDR L2
EASTLQS

SEQ ID NO: 158 - DNA, 21 bp, Artificial Sequence
  Description of Artificial Sequence: Synthetic light chain variable region CDR L2
gaagcatccactttgcaaagt

SEQ ID NO: 159 - protein, 9 aa, Artificial Sequence
  Description of Artificial Sequence: Synthetic light chain variable region CDR L3
QQYYIYPLT

SEQ ID NO: 160 - DNA, 27 bp, Artificial Sequence
  Description of Artificial Sequence: Synthetic light chain variable region CDR L3
caacagtattatatttacccgctcact

SEQ ID NO: 161 - DNA, 360 bp, Artificial Sequence
  Description of Artificial Sequence: Synthetic heavy chain variable region
gaggtgcagctggtggagtctgggggaggcttggtcaagcctggagggtccctaaggctctcctgtgcagcctctggaagctccttccgttattcctacatgagttgggtccgccaggctccagggaaggggctgcagtgggttgcatctattagtcctagtagcacttatacagactacgcagactctgtgaagggccgaagcaccatctccagagaccacgacaagatctctctgcaagtgaacagcctgagaggcgacgacacggccgtgtattattgtgtgagacatatgaatttggtgatggggccgttcgcctttgatatctggggccgcgggacaatggtcaccgtctcttca

SEQ ID NO: 162 - protein, 120 aa, Artificial Sequence
  Description of Artificial Sequence: Synthetic heavy chain variable region
EVQLVESGGGLVKPGGSLRLSCAASGSSFRYSYMSWVRQAPGKGLQWVASISPSSTYTDYADSVKGRSTISRDHDKISLQVNSLRGDDTAVYYCVRHMNLVMGPFAFDIWGRGTMVTVSS

SEQ ID NO: 163 - protein, 9 aa, Artificial Sequence
  Description of Artificial Sequence: Synthetic heavy chain variable region CDR H1
SSFRYSYMS

SEQ ID NO: 164 - DNA, 27 bp, Artificial Sequence
  Description of Artificial Sequence: Synthetic heavy chain variable region CDR H1
agctccttccgttattcctacatgagt

SEQ ID NO: 165 - protein, 17 aa, Artificial Sequence
  Description of Artificial Sequence: Synthetic heavy chain variable region CDR H2
SISPSSTYTDYADSVKG

SEQ ID NO: 166 - DNA, 51 bp, Artificial Sequence
  Description of Artificial Sequence: Synthetic heavy chain variable region CDR H2
tctattagtcctagtagcacttatacagactacgcagactctgtgaagggc

SEQ ID NO: 167 - protein, 15 aa, Artificial Sequence
  Description of Artificial Sequence: Synthetic heavy chain variable region CDR H3
VRHMNLVMGPFAFDI

SEQ ID NO: 168 - DNA, 45 bp, Artificial Sequence
  Description of Artificial Sequence: Synthetic heavy chain variable region CDR H3
gtgagacatatgaatttggtgatggggccgttcgcctttgatatc

SEQ ID NO: 169 - DNA, 330 bp, Artificial Sequence
  Description of Artificial Sequence: Synthetic light chain variable region
cagtctgtcgtgacgcagccgccctcattgtctggggccccagggcagaggatcaccatttcgtgcactgggagcagctccaacatcggggcaggttatgatgtaaactggtaccagcagcttccaggaacagcccccaaactcctcatctatgctaagaccaatcggccctcaggggtccctgagcgcttctctggttccgagtctggcacctccgcctccctggccatcactgggctccagcctgaggatgaggctgattattactgccagtcatatgacaggatcggaatgtatgtcttcggaactgggaccaagctgaccgtccta

SEQ ID NO: 170 - protein, 110 aa, Artificial Sequence
  Description of Artificial Sequence: Synthetic light chain variable region
QSVVTQPPSLSGAPGQRITISCTGSSSNIGAGYDVNWYQQLPGTAPKLLIYAKTNRPSGVPERFSGSESGTSASLAITGLQPEDEADYYCQSYDRIGMYVFGTGTKLTVL

SEQ ID NO: 171 - protein, 14 aa, Artificial Sequence
  Description of Artificial Sequence: Synthetic light chain variable region CDR L1
TGSSSNIGAGYDVN

SEQ ID NO: 172 - DNA, 42 bp, Artificial Sequence
  Description of Artificial Sequence: Synthetic light chain variable region CDR L1
actgggagcagctccaacatcggggcaggttatgatgtaaac

SEQ ID NO: 173 - protein, 7 aa, Artificial Sequence
  Description of Artificial Sequence: Synthetic light chain variable region CDR L2
AKTNRPS

SEQ ID NO: 174 - DNA, 21 bp, Artificial Sequence
  Description of Artificial Sequence: Synthetic light chain variable region CDR L2
gctaagaccaatcggccctca

SEQ ID NO: 175 - protein, 10 aa, Artificial Sequence
  Description of Artificial Sequence: Synthetic light chain variable region CDR L3
QSYDRIGMYV

SEQ ID NO: 176 - DNA, 30 bp, Artificial Sequence
  Description of Artificial Sequence: Synthetic light chain variable region CDR L3
cagtcatatgacaggatcggaatgtatgtc

SEQ ID NO: 177 - DNA, 384 bp, Artificial Sequence
  Description of Artificial Sequence: Synthetic heavy chain variable region
gaggtgcagctggtggagtctgggggagacttggtaaagcctggggggtccctcagactctcatgtgaaggctctggcttcatttttccgaacgcctggatgagctgggtccgccaggctccagggaaggggctggagtgggttggccgtattaaaagcaacactgacggtgggacaacagactacggtgcacccgtgaaaggcagattcaccatctcaagagatgattcaacaaacacgatgtatctgcacatgaacagcctgaagaccgaggacacagccgtgtatttctgttccacaggcccaccctataagtattttgatgagactggttattcggtcgttgactactggggccagggaaccctggtcaccgtctcctca

SEQ ID NO: 178 - protein, 128 aa, Artificial Sequence
  Description of Artificial Sequence: Synthetic heavy chain variable region
EVQLVESGGDLVKPGGSLRLSCEGSGFIFPNAWMSWVRQAPGKGLEWVGRIKSNTDGGTTDYGAPVKGRFTISRDDSTNTMYLHMNSLKTEDTAVYFCSTGPPYKYFDETGYSVVDYWGQGTLVTVSS

SEQ ID NO: 179 - protein, 9 aa, Artificial Sequence
  Description of Artificial Sequence: Synthetic heavy chain variable region CDR H1
FIFPNAWMS

SEQ ID NO: 180 - DNA, 27 bp, Artificial Sequence
  Description of Artificial Sequence: Synthetic heavy chain variable region CDR H1
ttcatttttccgaacgcctggatgagc

SEQ ID NO: 181 - protein, 19 aa, Artificial Sequence
  Description of Artificial Sequence: Synthetic heavy chain variable region CDR H2
RIKSNTDGGTTDYGAPVKG

SEQ ID NO: 182 - DNA, 57 bp, Artificial Sequence
  Description of Artificial Sequence: Synthetic heavy chain variable region CDR H2
cgtattaaaagcaacactgacggtgggacaacagactacggtgcacccgtgaaaggc

SEQ ID NO: 183 - protein, 19 aa, Artificial Sequence
  Description of Artificial Sequence: Synthetic heavy chain variable region CDR H3
STGPPYKYFDETGYSVVDY

SEQ ID NO: 184 - DNA, 57 bp, Artificial Sequence
  Description of Artificial Sequence: Synthetic heavy chain variable region CDR H3
tccacaggcccaccctataagtattttgatgagactggttattcggtcgttgactac

SEQ ID NO: 185 - DNA, 330 bp, Artificial Sequence
  Description of Artificial Sequence: Synthetic light chain variable region
tcctatgagctgacacagccaccctcagcgtctgggacccccgggcagagggtcatcatctcttgttctggaagcacgtccaattccggatataattatttttactggtatcagcagcgcccaggaacggcccccaaactcctcatctatggcagtgatcagcggccctcaggggtccctgaccgattctctggttcccagtctggcccctcagcctccctggccatcagtgggctccggtccgaggatgaggctcattattactgtgcagcgtgggatgacaacctgagtggtccggtgttcggcggagggaccaagctcaccgtccta

SEQ ID NO: 186 - protein, 110 aa, Artificial Sequence
  Description of Artificial Sequence: Synthetic light chain variable region
SYELTQPPSASGTPGQRVIISCSGSTSNSGYNYFYWYQQRPGTAPKLLIYGSDQRPSGVPDRFSGSQSGPSASLAISGLRSEDEAHYYCAAWDDNLSGPVFGGGTKLTVL

SEQ ID NO: 187 - protein, 13 aa, Artificial Sequence
  Description of Artificial Sequence: Synthetic light chain variable region CDR L1
SGSTSNSGYNYFY

SEQ ID NO: 188 - DNA, 39 bp, Artificial Sequence
  Description of Artificial Sequence: Synthetic light chain variable region CDR L1
tctggaagcacgtccaattccggatataattatttttac

SEQ ID NO: 189 - protein, 7 aa, Artificial Sequence
  Description of Artificial Sequence: Synthetic light chain variable region CDR L2
GSDQRPS

SEQ ID NO: 190 - DNA, 21 bp, Artificial Sequence
  Description of Artificial Sequence: Synthetic light chain variable region CDR L2
ggcagtgatcagcggccctca

SEQ ID NO: 191 - protein, 11 aa, Artificial Sequence
  Description of Artificial Sequence: Synthetic light chain variable region CDR L3
AAWDDNLSGPV

SEQ ID NO: 192 - DNA, 33 bp, Artificial Sequence
  Description of Artificial Sequence: Synthetic light chain variable region CDR L3
gcagcgtgggatgacaacctgagtggtccggtg

SEQ ID NO: 193 - DNA, 384 bp, Artificial Sequence
  Description of Artificial Sequence: Synthetic heavy chain variable region
caggtccagcttgtacagtctgggggaggcttggtaaagcctggggggtcccgaagactcgcatgtgcagcctctggattcatcttccgcaacgcctggatgagctgggtccgccaggctccagggaaggggctggagtgggttggccggattaaaaggacaagtgaaggagggtcagtcgactacgcgacacccgtgcaaggcagattctccatctcaagagatgattctagaaacacactgtatctacaaatgcacagcctggcacccgacgacacagccgtgtattactgttccacaggcccaccctattcttactttgatagtactggttattcggtcgtggactactggggccagggaaccctggtcaccgtctcttca

SEQ ID NO: 194 - protein, 128 aa, Artificial Sequence
  Description of Artificial Sequence: Synthetic heavy chain variable region
QVQLVQSGGGLVKPGGSRRLACAASGFIFRNAWMSWVRQAPGKGLEWVGRIKRTSEGGSVDYATPVQGRFSISRDDSRNTLYLQMHSLAPDDTAVYYCSTGPPYSYFDSTGYSVVDYWGQGTLVTVSS

SEQ ID NO: 195 - protein, 9 aa, Artificial Sequence
  Description of Artificial Sequence: Synthetic heavy chain variable region CDR H1
FIFRNAWMS

SEQ ID NO: 196 - DNA, 27 bp, Artificial Sequence
  Description of Artificial Sequence: Synthetic heavy chain variable region CDR H1
ttcatcttccgcaacgcctggatgagc

SEQ ID NO: 197 - protein, 19 aa, Artificial Sequence
  Description of Artificial Sequence: Synthetic heavy chain variable region CDR H2
RIKRTSEGGSVDYATPVQG

SEQ ID NO: 198 - DNA, 57 bp, Artificial Sequence
  Description of Artificial Sequence: Synthetic heavy chain variable region CDR H2
cggattaaaaggacaagtgaaggagggtcagtcgactacgcgacacccgtgcaaggc

SEQ ID NO: 199 - protein, 19 aa, Artificial Sequence
  Description of Artificial Sequence: Synthetic heavy chain variable region CDR H3
STGPPYSYFDSTGYSVVDY

SEQ ID NO: 200 - DNA, 57 bp, Artificial Sequence
  Description of Artificial Sequence: Synthetic heavy chain variable region CDR H3
tccacaggcccaccctattcttactttgatagtactggttattcggtcgtggactac

SEQ ID NO: 201 - DNA, 330 bp, Artificial Sequence
  Description of Artificial Sequence: Synthetic light chain variable region
cagtctgtgttgacgcagccgccctcagcgtctgggacccccgggcagagggtcaccatctcttgttctgcaagcagctccaacatcggagataattatttctactggtaccaacaactcccaggaaaggcccccacactcctcatgtatggtagtgaccagcggtcctcaggggtccctgaccgattctctggctcccagtctggcacctctgcctccctggccatcagtgggctccggtccgaggatgaagctgcttattattgtgcagcttgggatgacagcctgagtggtccggtgttcggcggaggcacccagctgaccgtcctc

SEQ ID NO: 202 - protein, 110 aa, Artificial Sequence
  Description of Artificial Sequence: Synthetic light chain variable region
QSVLTQPPSASGTPGQRVTISCSASSSNIGDNYFYWYQQLPGKAPTLLMYGSDQRSSGVPDRFSGSQSGTSASLAISGLRSEDEAAYYCAAWDDSLSGPVFGGGTQLTVL

SEQ ID NO: 203 - protein, 13 aa, Artificial Sequence
  Description of Artificial Sequence: Synthetic light chain variable region CDR L1
SASSSNIGDNYFY

SEQ ID NO: 204 - DNA, 39 bp, Artificial Sequence
  Description of Artificial Sequence: Synthetic light chain variable region CDR L1
tctgcaagcagctccaacatcggagataattatttctac

SEQ ID NO: 205 - protein, 7 aa, Artificial Sequence
  Description of Artificial Sequence: Synthetic light chain variable region CDR L2
GSDQRSS

SEQ ID NO: 206 - DNA, 21 bp, Artificial Sequence
  Description of Artificial Sequence: Synthetic light chain variable region CDR L2
ggtagtgaccagcggtcctca

SEQ ID NO: 207 - protein, 11 aa, Artificial Sequence
  Description of Artificial Sequence: Synthetic light chain variable region CDR L3
AAWDDSLSGPV

SEQ ID NO: 208 - DNA, 33 bp, Artificial Sequence
  Description of Artificial Sequence: Synthetic light chain variable region CDR L3
gcagcttgggatgacagcctgagtggtccggtg

SEQ ID NO: 209 - DNA, 369 bp, Artificial Sequence
  Description of Artificial Sequence: Synthetic heavy chain variable region
gaggtgcagctggtggagtctggggctgaggtgaggaagcctggggcctcagtgaaggtctcctgcaaggcttctggatacatcttcattaactactatatacactgggtgcgacaggcccctggacaaggtcttgagtggatggggtggatcaaccctaacagtggagcctcaaaccacgcacagacgttcgagggcaggatcaccatgaccaccgacacgtccagcaacacagcctacatggagctgagtagactgagagaggacgacacggccgtctattactgtgcgagatcccagcaactgctcgttatcaccgattactccttagactactggggcctgggaaccctggtcaccgtctcctca

SEQ ID NO: 210 - protein, 123 aa, Artificial Sequence
  Description of Artificial Sequence: Synthetic heavy chain variable region
EVQLVESGAEVRKPGASVKVSCKASGYIFINYYIHWVRQAPGQGLEWMGWINPNSGASNHAQTFEGRITMTTDTSSNTAYMELSRLREDDTAVYYCARSQQLLVITDYSLDYWGLGTLVTVSS

SEQ ID NO: 211 - protein, 9 aa, Artificial Sequence
  Description of Artificial Sequence: Synthetic heavy chain variable region CDR H1
YIFINYYIH

SEQ ID NO: 212 - DNA, 27 bp, Artificial Sequence
  Description of Artificial Sequence: Synthetic heavy chain variable region CDR H1
tacatcttcattaactactatatacac

SEQ ID NO: 213 - protein, 17 aa, Artificial Sequence
  Description of Artificial Sequence: Synthetic heavy chain variable region CDR H2
WINPNSGASNHAQTFEG

SEQ ID NO: 214 - DNA, 51 bp, Artificial Sequence
  Description of Artificial Sequence: Synthetic heavy chain variable region CDR H2
tggatcaaccctaacagtggagcctcaaaccacgcacagacgttcgagggc

SEQ ID NO: 215 - protein, 16 aa, Artificial Sequence
  Description of Artificial Sequence: Synthetic heavy chain variable region CDR H3
ARSQQLLVITDYSLDY

SEQ ID NO: 216 - DNA, 48 bp, Artificial Sequence
  Description of Artificial Sequence: Synthetic heavy chain variable region CDR H3
gcgagatcccagcaactgctcgttatcaccgattactccttagactac

SEQ ID NO: 217 - DNA, 324 bp, Artificial Sequence
  Description of Artificial Sequence: Synthetic light chain variable region
tcctctgagctgactcaggaccctgctgtgtctgtggccttgggacagacagtcaggatcacatgccacggagacaccctcagaaactattatccagcctggtaccagcagaagccaggacaggcccctgttcttgtcgtgtctgatagaaacacccggccctcagggatcccagaccgattctctgtctccacctcaggaaacacagcttccttgaccatcactggggctcaggcggaagatgagggtgactattactgtaactgccgcgacagcagtggtcaccggctggtcttcggcggagggaccaagctgaccgtccta

SEQ ID NO: 218 - protein, 108 aa, Artificial Sequence
  Description of Artificial Sequence: Synthetic light chain variable region
SSELTQDPAVSVALGQTVRITCHGDTLRNYYPAWYQQKPGQAPVLVVSDRNTRPSGIPDRFSVSTSGNTASLTITGAQAEDEGDYYCNCRDSSGHRLVFGGGTKLTVL

SEQ ID NO: 219 - protein, 11 aa, Artificial Sequence
  Description of Artificial Sequence: Synthetic light chain variable region CDR L1
HGDTLRNYYPA

SEQ ID NO: 220 - DNA, 33 bp, Artificial Sequence
  Description of Artificial Sequence: Synthetic light chain variable region CDR L1
cacggagacaccctcagaaactattatccagcc

SEQ ID NO: 221 - protein, 7 aa, Artificial Sequence
  Description of Artificial Sequence: Synthetic light chain variable region CDR L2
DRNTRPS

SEQ ID NO: 222 - DNA, 21 bp, Artificial Sequence
  Description of Artificial Sequence: Synthetic light chain variable region CDR L2
gatagaaacacccggccctca

SEQ ID NO: 223 - protein, 11 aa, Artificial Sequence
  Description of Artificial Sequence: Synthetic light chain variable region CDR L3
NCRDSSGHRLV

SEQ ID NO: 224 - DNA, 33 bp, Artificial Sequence
  Description of Artificial Sequence: Synthetic light chain variable region CDR L3
aactgccgcgacagcagtggtcaccggctggtc

SEQ ID NO: 225 - DNA, 378 bp, Artificial Sequence
  Description of Artificial Sequence: Synthetic heavy chain variable region
caggtccagcttgtgcagtctggggctgaggtgaagaagcctgggtcctcggtgaaggtctcctgcgaggcttctggagacaccttcaccagttatgcagtcatctgggtgcgccaggccccaggacaagggcttgagtggatgggaagtatcatccctatctttcaaacaatcaactacgcaccaaagttccaggggagggtcaccctaagcgcggacggatctacgagaacagtctacatggagttgggaagcctgagatcagaggacacggccatatatttctgtgcgaccaagagatactgtactagtcccagctgccatggactctggtacttcaatctctggggccgtggaaccctggtcaccgtctcctca

SEQ ID NO: 226 - protein, 126 aa, Artificial Sequence
  Description of Artificial Sequence: Synthetic heavy chain variable region
QVQLVQSGAEVKKPGSSVKVSCEASGDTFTSYAVIWVRQAPGQGLEWMGSIIPIFQTINYAPKFQGRVTLSADGSTRTVYMELGSLRSEDTAIYFCATKRYCTSPSCHGLWYFNLWGRGTLVTVSS

SEQ ID NO: 227 - protein, 9 aa, Artificial Sequence
  Description of Artificial Sequence: Synthetic heavy chain variable region CDR H1
DTFTSYAVI

SEQ ID NO: 228 - DNA, 27 bp, Artificial Sequence
  Description of Artificial Sequence: Synthetic heavy chain variable region CDR H1
gacaccttcaccagttatgcagtcatc

SEQ ID NO: 229 - protein, 17 aa, Artificial Sequence
  Description of Artificial Sequence: Synthetic heavy chain variable region CDR H2
SIIPIFQTINYAPKFQG

SEQ ID NO: 230 - DNA, 51 bp, Artificial Sequence
  Description of Artificial Sequence: Synthetic heavy chain variable region CDR H2
agtatcatccctatctttcaaacaatcaactacgcaccaaagttccagggg

SEQ ID NO: 231 - protein, 19 aa, Artificial Sequence
  Description of Artificial Sequence: Synthetic heavy chain variable region CDR H3
ATKRYCTSPSCHGLWYFNL

SEQ ID NO: 232 - DNA, 57 bp, Artificial Sequence
  Description of Artificial Sequence: Synthetic heavy chain variable region CDR H3
gcgaccaagagatactgtactagtcccagctgccatggactctggtacttcaatctc

SEQ ID NO: 233 - DNA, 339 bp, Artificial Sequence
  Description of Artificial Sequence: Synthetic light chain variable region
gatattgtgatgacccagtctccactctccctgcccgtcacccctggagagccggcctccatctcctgcaggtctagtaagagcctcttggatagtgatgatggaaacacctatttggactggtacctgcagaagccagggcagtctccacagatcctgatctatatgctttcgcatcgggcctctggagtcccagacaggttcagtggcagtgggtcaggcactgacttcacactgaaaatcagtagggtggaggctgaggatgttggagtttattactgcatgcaacgtgtagagtatccttacagttttggccaggggaccaaggtggagatcaaa

SEQ ID NO: 234 - protein, 113 aa, Artificial Sequence
  Description of Artificial Sequence: Synthetic light chain variable region
DIVMTQSPLSLPVTPGEPASISCRSSKSLLDSDDGNTYLDWYLQKPGQSPQILIYMLSHRASGVPDRFSGSGSGTDFTLKISRVEAEDVGVYYCMQRVEYPYSFGQGTKVEIK

SEQ ID NO: 235 - protein, 17 aa, Artificial Sequence
  Description of Artificial Sequence: Synthetic light chain variable region CDR L1
RSSKSLLDSDDGNTYLD

SEQ ID NO: 236 - DNA, 51 bp, Artificial Sequence
  Description of Artificial Sequence: Synthetic light chain variable region CDR L1
aggtctagtaagagcctcttggatagtgatgatggaaacacctatttggac

SEQ ID NO: 237 - protein, 7 aa, Artificial Sequence
  Description of Artificial Sequence: Synthetic light chain variable region CDR L2
MLSHRAS

SEQ ID NO: 238 - DNA, 21 bp, Artificial Sequence
  Description of Artificial Sequence: Synthetic light chain variable region CDR L2
atgctttcgcatcgggcctct

SEQ ID NO: 239 - protein, 9 aa, Artificial Sequence
  Description of Artificial Sequence: Synthetic light chain variable region CDR L3
MQRVEYPYS

SEQ ID NO: 240 - DNA, 27 bp, Artificial Sequence
  Description of Artificial Sequence: Synthetic light chain variable region CDR L3
atgcaacgtgtagagtatccttacagt

SEQ ID NO: 241 - DNA, 378 bp, Artificial Sequence
  Description of Artificial Sequence: Synthetic heavy chain variable region
cagatcaccttgaaggagtctgggcctaccgtggtgaaacccacacagaccctcacactgacctgcaccttctctgggttctcactcaacactcgtggcatgggtgtggcctggatccgtcagcccccaggaggggccctggagtggcttgcactcgttgattgggatgatgataagcgctacagcccttctctgaggagcaggctcaccatcaccaaagacacgtccaagaaccaggtgctctttacaatgaccaccatggaccccgcggacacagccacgtactactgtgcacacatcggtctttatgatcgtggtggctattacttattctactttgacttttggggccagggaaccctggtcaccgtctcctca

SEQ ID NO: 242 - protein, 126 aa, Artificial Sequence
  Description of Artificial Sequence: Synthetic heavy chain variable region
QITLKESGPTVVKPTQTLTLTCTFSGFSLNTRGMGVAWIRQPPGGALEWLALVDWDDDKRYSPSLRSRLTITKDTSKNQVLFTMTTMDPADTATYYCAHIGLYDRGGYYLFYFDFWGQGTLVTVSS

SEQ ID NO: 243 - protein, 11 aa, Artificial Sequence
  Description of Artificial Sequence: Synthetic heavy chain variable region CDR H1
FSLNTRGMGVA

SEQ ID NO: 244 - DNA, 33 bp, Artificial Sequence
  Description of Artificial Sequence: Synthetic heavy chain variable region CDR H1
ttctcactcaacactcgtggcatgggtgtggcc

SEQ ID NO: 245 - protein, 16 aa, Artificial Sequence
  Description of Artificial Sequence: Synthetic heavy chain variable region CDR H2
LVDWDDDKRYSPSLRS

SEQ ID NO: 246 - DNA, 48 bp, Artificial Sequence
  Description of Artificial Sequence: Synthetic heavy chain variable region CDR H2
ctcgttgattgggatgatgataagcgctacagcccttctctgaggagc

SEQ ID NO: 247 - protein, 18 aa, Artificial Sequence
  Description of Artificial Sequence: Synthetic heavy chain variable region CDR H3
AHIGLYDRGGYYLFYFDF

SEQ ID NO: 248 - DNA, 54 bp, Artificial Sequence
  Description of Artificial Sequence: Synthetic heavy chain variable region CDR H3
gcacacatcggtctttatgatcgtggtggctattacttattctactttgacttt

SEQ ID NO: 249 - DNA, 321 bp, Artificial Sequence
  Description of Artificial Sequence: Synthetic light chain variable region
gatattgtgctgacgcagtctccatcctccctgtctgcgtctgtaggcgacagggtcaccatcacttgccgggcaagtcagagcattgccagctatgtgaattggtttcagcagaaaccagggaaagcccctgtcctcttgatgtttgcttcatccattttgcaaagtggcgtcccgccaaggttccgtggcagtggatctgggacagatttcactctcaccatcaccagtctccagcctgaagattttgcaacttactactgtcaacacacttacaccaccccgtacatttttggccgggggaccaaagtggagatcaaa

SEQ ID NO: 250 - protein, 107 aa, Artificial Sequence
  Description of Artificial Sequence: Synthetic light chain variable region
DIVLTQSPSSLSASVGDRVTITCRASQSIASYVNWFQQKPGKAPVLLMFASSILQSGVPPRFRGSGSGTDFTLTITSLQPEDFATYYCQHTYTTPYIFGRGTKVEIK

SEQ ID NO: 251 - protein, 11 aa, Artificial Sequence
  Description of Artificial Sequence: Synthetic light chain variable region CDR L1
RASQSIASYVN

SEQ ID NO: 252 - DNA, 33 bp, Artificial Sequence
  Description of Artificial Sequence: Synthetic light chain variable region CDR L1
cgggcaagtcagagcattgccagctatgtgaat

SEQ ID NO: 253 - protein, 7 aa, Artificial Sequence
  Description of Artificial Sequence: Synthetic light chain variable region CDR L2
ASSILQS

SEQ ID NO: 254 - DNA, 21 bp, Artificial Sequence
  Description of Artificial Sequence: Synthetic light chain variable region CDR L2
gcttcatccattttgcaaagt

SEQ ID NO: 255 - protein, 9 aa, Artificial Sequence
  Description of Artificial Sequence: Synthetic light chain variable region CDR L3
QHTYTTPYI

SEQ ID NO: 256 - DNA, 27 bp, Artificial Sequence
  Description of Artificial Sequence: Synthetic light chain variable region CDR L3
caacacacttacaccaccccgtacatt

SEQ ID NO: 257 - DNA, 378 bp, Artificial Sequence
  Description of Artificial Sequence: Synthetic heavy chain variable region
caggtccagcttgtgcagtctggtcctacgctggtgaaacccacacagaccctcacgctgacctgcaccttctctggcttctcactcagcactcgtggagtgggtgtgggctggatccgtcagcccccaggaaaggccctggagtgccttggattcacttattgggatggtgatcagttccacagcccatctctgaagaacagactcaccattaccaaggacacctccaaaaaccaggtggtccttagaatgaccaacatggaccctgtggacacggccacctatttctgtgtacacagcgatctctatgatagtggtggttattacttgtactactttgactactggggccagggaaccctggtcaccgtctcctca

SEQ ID NO: 258 - protein, 126 aa, Artificial Sequence
  Description of Artificial Sequence: Synthetic heavy chain variable region
QVQLVQSGPTLVKPTQTLTLTCTFSGFSLSTRGVGVGWIRQPPGKALECLGFTYWDGDQFHSPSLKNRLTITKDTSKNQVVLRMTNMDPVDTATYFCVHSDLYDSGGYYLYYFDYWGQGTLVTVSS

SEQ ID NO: 259 - protein, 11 aa, Artificial Sequence
  Description of Artificial Sequence: Synthetic heavy chain variable region CDR H1
FSLSTRGVGVG

SEQ ID NO: 260 - DNA, 33 bp, Artificial Sequence
  Description of Artificial Sequence: Synthetic heavy chain variable region CDR H1
ttctcactcagcactcgtggagtgggtgtgggc

SEQ ID NO: 261 - protein, 16 aa, Artificial Sequence
  Description of Artificial Sequence: Synthetic heavy chain variable region CDR H2
FTYWDGDQFHSPSLKN

SEQ ID NO: 262 - DNA, 48 bp, Artificial Sequence
  Description of Artificial Sequence: Synthetic heavy chain variable region CDR H2
ttcacttattgggatggtgatcagttccacagcccatctctgaagaac

SEQ ID NO: 263 - protein, 18 aa, Artificial Sequence
  Description of Artificial Sequence: Synthetic heavy chain variable region CDR H3
VHSDLYDSGGYYLYYFDY

SEQ ID NO: 264 - DNA, 54 bp, Artificial Sequence
  Description of Artificial Sequence: Synthetic heavy chain variable region CDR H3
gtacacagcgatctctatgatagtggtggttattacttgtactactttgactac

SEQ ID NO: 265 - DNA, 321 bp, Artificial Sequence
  Description of Artificial Sequence: Synthetic light chain variable region
gacatccagatgacccagtctccatcctccctgtctgcttctgtgggggacagagtcaccatcacttgccgagccagtcagaccattgccagttatttaaattggtatcagcaaagaccaggggaagcccctaaactcttgatctatgctgcttccagtttgcagagtggggtctcatcaagattcagtggcaggggatctgggacagatttcactctcaccatcaatattctacaacctgaggatcttgcaacttacttctgtcaacaggcttactctgccccgtacacttttggccaggggaccaaggtggaaatcaaa

SEQ ID NO: 266 - protein, 107 aa, Artificial Sequence
  Description of Artificial Sequence: Synthetic light chain variable region
DIQMTQSPSSLSASVGDRVTITCRASQTIASYLNWYQQRPGEAPKLLIYAASSLQSGVSSRFSGRGSGTDFTLTINILQPEDLATYFCQQAYSAPYTFGQGTKVEIK

SEQ ID NO: 267 - protein, 11 aa, Artificial Sequence
  Description of Artificial Sequence: Synthetic light chain variable region CDR L1
RASQTIASYLN

SEQ ID NO: 268 - DNA, 33 bp, Artificial Sequence
  Description of Artificial Sequence: Synthetic light chain variable region CDR L1
cgagccagtcagaccattgccagttatttaaat

SEQ ID NO: 269 - protein, 7 aa, Artificial Sequence
  Description of Artificial Sequence: Synthetic light chain variable region CDR L2
AASSLQS

SEQ ID NO: 270 - DNA, 21 bp, Artificial Sequence
  Description of Artificial Sequence: Synthetic light chain variable region CDR L2
gctgcttccagtttgcagagt

SEQ ID NO: 271 - protein, 9 aa, Artificial Sequence
  Description of Artificial Sequence: Synthetic light chain variable region CDR L3
QQAYSAPYT

SEQ ID NO: 272 - DNA, 27 bp, Artificial Sequence
  Description of Artificial Sequence: Synthetic light chain variable region CDR L3
caacaggcttactctgccccgtacact

SEQ ID NO: 273 - DNA, 363 bp, Artificial Sequence
  Description of Artificial Sequence: Synthetic heavy chain variable region
caggtccagctggtacagtctggagctgaggtgaagaagcctggggcctcagtgaaggtctcctgcaaggcttctggttacacctttaccagctatggtaccagctgggtgcgacaggcccctggacaagggcttgagtggatgggatggatcagcgcttacaatggtaacacaaactatgcacagaatctccagggcagagtcaccatgaccacagacacatcaacgagcacatcctacatggagctgaggagcctgagatctgacgacacggccgtgtattactgtgcgagagatgtccccgtcatagcagctggtacaatggactactggggccagggaaccctggtcaccgtctcctca

SEQ ID NO: 274 - protein, 121 aa, Artificial Sequence
  Description of Artificial Sequence: Synthetic heavy chain variable region
QVQLVQSGAEVKKPGASVKVSCKASGYTFTSYGTSWVRQAPGQGLEWMGWISAYNGNTNYAQNLQGRVTMTTDTSTSTSYMELRSLRSDDTAVYYCARDVPVIAAGTMDYWGQGTLVTVSS

SEQ ID NO: 275 - protein, 9 aa, Artificial Sequence
  Description of Artificial Sequence: Synthetic heavy chain variable region CDR H1
YTFTSYGTS

SEQ ID NO: 276 - DNA, 27 bp, Artificial Sequence
  Description of Artificial Sequence: Synthetic heavy chain variable region CDR H1
tacacctttaccagctatggtaccagc

SEQ ID NO: 277 - protein, 17 aa, Artificial Sequence
  Description of Artificial Sequence: Synthetic heavy chain variable region CDR H2
WISAYNGNTNYAQNLQG

SEQ ID NO: 278 - DNA, 51 bp, Artificial Sequence
  Description of Artificial Sequence: Synthetic heavy chain variable region CDR H2
tggatcagcgcttacaatggtaacacaaactatgcacagaatctccagggc

SEQ ID NO: 279 - protein, 14 aa, Artificial Sequence
  Description of Artificial Sequence: Synthetic heavy chain variable region CDR H3
ARDVPVIAAGTMDY

SEQ ID NO: 280 - DNA, 42 bp, Artificial Sequence
  Description of Artificial Sequence: Synthetic heavy chain variable region CDR H3
gcgagagatgtccccgtcatagcagctggtacaatggactac

SEQ ID NO: 281 - DNA, 336 bp, Artificial Sequence
  Description of Artificial Sequence: Synthetic light chain variable region
gatattgtgatgacccagactccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaatcgggactctggggtcccagacagattcagcggcagtgggtcaggcactgatttcacactgaaaatcagcagggtggaggctgaggatgttggggtttattactgcatgcaaggtccacactggcctcgaacgttcggccaagggaccaaggtggaaatcaaa

SEQ ID NO: 282 - protein, 112 aa, Artificial Sequence
  Description of Artificial Sequence: Synthetic light chain variable region
DIVMTQTPLSLPVTLGQPASISCRSSQSLVYSDGNTYLNWFQQRPGQSPRRLIYKVSNRDSGVPDRFSGSGSGTDFTLKISRVEAEDVGVYYCMQGPHWPRTFGQGTKVEIK

SEQ ID NO: 283 - protein, 16 aa, Artificial Sequence
  Description of Artificial Sequence: Synthetic light chain variable region CDR L1
RSSQSLVYSDGNTYLN

SEQ ID NO: 284 - DNA, 48 bp, Artificial Sequence
  Description of Artificial Sequence: Synthetic light chain variable region CDR L1
aggtctagtcaaagcctcgtatacagtgatggaaacacctacttgaat

SEQ ID NO: 285 - protein, 7 aa, Artificial Sequence
  Description of Artificial Sequence: Synthetic light chain variable region CDR L2
KVSNRDS

SEQ ID NO: 286 - DNA, 21 bp, Artificial Sequence
  Description of Artificial Sequence: Synthetic light chain variable region CDR L2
aaggtttctaatcgggactct

SEQ ID NO: 287 - protein, 9 aa, Artificial Sequence
  Description of Artificial Sequence: Synthetic light chain variable region CDR L3
MQGPHWPRT

SEQ ID NO: 288 - DNA, 27 bp, Artificial Sequence
  Description of Artificial Sequence: Synthetic light chain variable region CDR L3
atgcaaggtccacactggcctcgaacg

SEQ ID NO: 289 - DNA, 372 bp, Artificial Sequence
  Description of Artificial Sequence: Synthetic heavy chain variable region
caggtccagcttgtgcagtctggggctgaggtgaagaagcctggggcctcagtgaaagtctcgtgtgaggcctctgaatacagtttcagtggcgactatgttcactgggtgcgacaggcccctggacaagggcttgagtggatgggttggataaaggctgtcaatggtggcgcgaactacgcacagaagtttcacggcagggtcacaatgaccactgactcgtccaagagcacagtctatttggagatgagcagactgacacctgccgacacggccatttatttttgtgcgaaggatcgggctgcaagtgttcatgtgccagcgggcgcgtttgacctctggggccagggaaccctggtcaccgtctcctca

SEQ ID NO: 290 - protein, 124 aa, Artificial Sequence
  Description of Artificial Sequence: Synthetic heavy chain variable region
QVQLVQSGAEVKKPGASVKVSCEASEYSFSGDYVHWVRQAPGQGLEWMGWIKAVNGGANYAQKFHGRVTMTTDSSKSTVYLEMSRLTPADTAIYFCAKDRAASVHVPAGAFDLWGQGTLVTVSS

SEQ ID NO: 291 - protein, 9 aa, Artificial Sequence
  Description of Artificial Sequence: Synthetic heavy chain variable region CDR H1
YSFSGDYVH

SEQ ID NO: 292 - DNA, 27 bp, Artificial Sequence
  Description of Artificial Sequence: Synthetic heavy chain variable region CDR H1
tacagtttcagtggcgactatgttcac

SEQ ID NO: 293 - protein, 17 aa, Artificial Sequence
  Description of Artificial Sequence: Synthetic heavy chain variable region CDR H2
WIKAVNGGANYAQKFHG

SEQ ID NO: 294 - DNA, 51 bp, Artificial Sequence
  Description of Artificial Sequence: Synthetic heavy chain variable region CDR H2
tggataaaggctgtcaatggtggcgcgaactacgcacagaagtttcacggc

SEQ ID NO: 295 - protein, 17 aa, Artificial Sequence
  Description of Artificial Sequence: Synthetic heavy chain variable region CDR H3
AKDRAASVHVPAGAFDL

SEQ ID NO: 296 - DNA, 51 bp, Artificial Sequence
  Description of Artificial Sequence: Synthetic heavy chain variable region CDR H3
gcgaaggatcgggctgcaagtgttcatgtgccagcgggcgcgtttgacctc

SEQ ID NO: 297 - DNA, 324 bp, Artificial Sequence
  Description of Artificial Sequence: Synthetic light chain variable region
gacatccagatgacccagtctccttcctccctgtctgcatatgtaggagacagagtcagcatcacttgtcgggcaagtcagagcattgacaactttttaaattggtatcggcagagaccagggaaagcccctgaactcctaatctatgctgcctccactttgcaaggtggggtcccatcaaggttcagtggcagtggatctgggacacatttcactctcaccatcagcagtctccagcctgaagattttgccacttactactgtcaacagagtttcactattccttcgatcaccttcggccaagggacacgactggagattaaa

SEQ ID NO: 298 - protein, 108 aa, Artificial Sequence
  Description of Artificial Sequence: Synthetic light chain variable region
DIQMTQSPSSLSAYVGDRVSITCRASQSIDNFLNWYRQRPGKAPELLIYAASTLQGGVPSRFSGSGSGTHFTLTISSLQPEDFATYYCQQSFTIPSITFGQGTRLEIK

SEQ ID NO: 299 - protein, 11 aa, Artificial Sequence
  Description of Artificial Sequence: Synthetic light chain variable region CDR L1
RASQSIDNFLN

SEQ ID NO: 300 - DNA, 33 bp, Artificial Sequence
  Description of Artificial Sequence: Synthetic light chain variable region CDR L1
cgggcaagtcagagcattgacaactttttaaat

SEQ ID NO: 301 - protein, 7 aa, Artificial Sequence
  Description of Artificial Sequence: Synthetic light chain variable region CDR L2
AASTLQG

SEQ ID NO: 302 - DNA, 21 bp, Artificial Sequence
  Description of Artificial Sequence: Synthetic light chain variable region CDR L2
gctgcctccactttgcaaggt

SEQ ID NO: 303 - protein, 10 aa, Artificial Sequence
  Description of Artificial Sequence: Synthetic light chain variable region CDR L3
QQSFTIPSIT

SEQ ID NO: 304 - DNA, 30 bp, Artificial Sequence
  Description of Artificial Sequence: Synthetic light chain variable region CDR L3
caacagagtttcactattccttcgatcacc

SEQ ID NO: 305 - DNA, 378 bp, Artificial Sequence
  Description of Artificial Sequence: Synthetic heavy chain variable region
caggtcaccttgaaggagtctggtcctgcgctggtgagacccaaacagaccctcactctgacctgctccttctccggcttctcactcgacactcaaagaacgggtgtgaattggatccgtcagtccccagggaaggccctggagtggcttgcacggattgattgggatggcaatatttactccagcacctctgtgaggaccaaactcagcatctccaagggcacctccaaaaaccaggtggtccttacaatgaccgacgtggaccctgtggacacagccacctattactgtgcacggactctttactatacttctggtggttattacttgaacctctttgactactggggccaaggaaccctggtcaccgtctcctca

SEQ ID NO: 306 - protein, 126 aa, Artificial Sequence
  Description of Artificial Sequence: Synthetic heavy chain variable region
QVTLKESGPALVRPKQTLTLTCSFSGFSLDTQRTGVNWIRQSPGKALEWLARIDWDGNIYSSTSVRTKLSISKGTSKNQVVLTMTDVDPVDTATYYCARTLYYTSGGYYLNLFDYWGQGTLVTVSS

SEQ ID NO: 307 - protein, 11 aa, Artificial Sequence
  Description of Artificial Sequence: Synthetic heavy chain variable region CDR H1
FSLDTQRTGVN

SEQ ID NO: 308 - DNA, 33 bp, Artificial Sequence
  Description of Artificial Sequence: Synthetic heavy chain variable region CDR H1
ttctcactcgacactcaaagaacgggtgtgaat

SEQ ID NO: 309 - protein, 16 aa, Artificial Sequence
  Description of Artificial Sequence: Synthetic heavy chain variable region CDR H2
RIDWDGNIYSSTSVRT

SEQ ID NO: 310 - DNA, 48 bp, Artificial Sequence
  Description of Artificial Sequence: Synthetic heavy chain variable region CDR H2
cggattgattgggatggcaatatttactccagcacctctgtgaggacc

SEQ ID NO: 311 - protein, 18 aa, Artificial Sequence
  Description of Artificial Sequence: Synthetic heavy chain variable region CDR H3
ARTLYYTSGGYYLNLFDY

SEQ ID NO: 312 - DNA, 54 bp, Artificial Sequence
  Description of Artificial Sequence: Synthetic heavy chain variable region CDR H3
gcacggactctttactatacttctggtggttattacttgaacctctttgactac

SEQ ID NO: 313 - DNA, 321 bp, Artificial Sequence
  Description of Artificial Sequence: Synthetic light chain variable region
gaaattgtaatgacacagtctccaccctccctgtctgcctctgttggggacagagtcaccatcacttgccgggcaagtcagacaattcccagctatgtcaattggtatcagcagatatcagggaaagcccctcgcctcctgatctatgctgcctcacttttgcaaagtggggtcccatcaaggttcagtggcagcggatctgggacagagttcagtctcaccatcagcggtctgcgacctgaggattttggcacttactactgtcaacagagttacagttccactcccactttcggccaggggaccaaggtggaaatcaaa

SEQ ID NO: 314 - protein, 107 aa, Artificial Sequence
  Description of Artificial Sequence: Synthetic light chain variable region
EIVMTQSPPSLSASVGDRVTITCRASQTIPSYVNWYQQISGKAPRLLIYAASLLQSGVPSRFSGSGSGTEFSLTISGLRPEDFGTYYCQQSYSSTPTFGQGTKVEIK

SEQ ID NO: 315 - protein, 11 aa, Artificial Sequence
  Description of Artificial Sequence: Synthetic light chain variable region CDR L1
RASQTIPSYVN

SEQ ID NO: 316 - DNA, 33 bp, Artificial Sequence
  Description of Artificial Sequence: Synthetic light chain variable region CDR L1
cgggcaagtcagacaattcccagctatgtcaat

SEQ ID NO: 317 - protein, 7 aa, Artificial Sequence
  Description of Artificial Sequence: Synthetic light chain variable region CDR L2
AASLLQS

SEQ ID NO: 318 - DNA, 21 bp, Artificial Sequence
  Description of Artificial Sequence: Synthetic light chain variable region CDR L2
gctgcctcacttttgcaaagt

SEQ ID NO: 319 - protein, 9 aa, Artificial Sequence
  Description of Artificial Sequence: Synthetic light chain variable region CDR L3
QQSYSSTPT

SEQ ID NO: 320 - DNA, 27 bp, Artificial Sequence
  Description of Artificial Sequence: Synthetic light chain variable region CDR L3
caacagagttacagttccactcccact

SEQ ID NO: 321 - DNA, 384 bp, Artificial Sequence
  Description of Artificial Sequence: Synthetic heavy chain variable region
caggtgcagctggtggagtctgggggaggcttggtaaagcctggggggtccctgagactctcatgtgcagcctctggattcattttcagtaacgcctggatgagttgggtccgccagtctccagggaaggggctggagtgggttggccgtattaaaaccaaaactgagggtgcgacaacagaccacgctgcacccctgaaaggcagattcaccatctcaagagatgattcgagaaacacactgtatctccaaatggacagcctgacaaccgaggacacagccgtgtatttttgtaccacaggcccaccttatagttactttgacagtactgggtattccatcgttgactactggggccagggaaccctggtcaccgtctcctca

SEQ ID NO: 322 - protein, 128 aa, Artificial Sequence
  Description of Artificial Sequence: Synthetic heavy chain variable region
QVQLVESGGGLVKPGGSLRLSCAASGFIFSNAWMSWVRQSPGKGLEWVGRIKTKTEGATTDHAAPLKGRFTISRDDSRNTLYLQMDSLTTEDTAVYFCTTGPPYSYFDSTGYSIVDYWGQGTLVTVSS

SEQ ID NO: 323 - protein, 9 aa, Artificial Sequence
  Description of Artificial Sequence: Synthetic heavy chain variable region CDR H1
FIFSNAWMS

SEQ ID NO: 324 - DNA, 27 bp, Artificial Sequence
  Description of Artificial Sequence: Synthetic heavy chain variable region CDR H1
ttcattttcagtaacgcctggatgagt

SEQ ID NO: 325 - protein, 19 aa, Artificial Sequence
  Description of Artificial Sequence: Synthetic heavy chain variable region CDR H2
RIKTKTEGATTDHAAPLKG

SEQ ID NO: 326 - DNA, 57 bp, Artificial Sequence
  Description of Artificial Sequence: Synthetic heavy chain variable region CDR H2
cgtattaaaaccaaaactgagggtgcgacaacagaccacgctgcacccctgaaaggc

SEQ ID NO: 327 - protein, 19 aa, Artificial Sequence
  Description of Artificial Sequence: Synthetic heavy chain variable region CDR H3
TTGPPYSYFDSTGYSIVDY

SEQ ID NO: 328 - DNA, 57 bp, Artificial Sequence
  Description of Artificial Sequence: Synthetic heavy chain variable region CDR H3
accacaggcccaccttatagttactttgacagtactgggtattccatcgttgactac

SEQ ID NO: 329 - DNA, 330 bp, Artificial Sequence
  Description of Artificial Sequence: Synthetic light chain variable region
tcttatgagctgacacagccacccgcagcgtctgggacccccgggcagagggtcaccatctcttgttccggaagcagctccaacatcggaagtgagtatgtattgtggtatcagcaggtcccaggaacggcccccaaactcctcatctataatagtcatcagcggccctcaggggtccctgaccgcatttctggctcccggtctggcacctctgcctccctggccatcagtgggctccggtccgaggatgaggctcattattactgtgcatcctgggatgacagcctgagtggtccggttttcggcggagggacccagctgaccgtcctc

SEQ ID NO: 330 - protein, 110 aa, Artificial Sequence
  Description of Artificial Sequence: Synthetic light chain variable region
SYELTQPPAASGTPGQRVTISCSGSSSNIGSEYVLWYQQVPGTAPKLLIYNSHQRPSGVPDRISGSRSGTSASLAISGLRSEDEAHYYCASWDDSLSGPVFGGGTQLTVL

SEQ ID NO: 331 - protein, 13 aa, Artificial Sequence
  Description of Artificial Sequence: Synthetic light chain variable region CDR L1
SGSSSNIGSEYVL

SEQ ID NO: 332 - DNA, 39 bp, Artificial Sequence
  Description of Artificial Sequence: Synthetic light chain variable region CDR L1
tccggaagcagctccaacatcggaagtgagtatgtattg

SEQ ID NO: 333 - protein, 7 aa, Artificial Sequence
  Description of Artificial Sequence: Synthetic light chain variable region CDR L2
NSHQRPS

SEQ ID NO: 334 - DNA, 21 bp, Artificial Sequence
  Description of Artificial Sequence: Synthetic light chain variable region CDR L2
aatagtcatcagcggccctca

SEQ ID NO: 335 - protein, 11 aa, Artificial Sequence
  Description of Artificial Sequence: Synthetic light chain variable region CDR L3
ASWDDSLSGPV

SEQ ID NO: 336 - DNA, 33 bp, Artificial Sequence
  Description of Artificial Sequence: Synthetic light chain variable region CDR L3
gcatcctgggatgacagcctgagtggtccggtt

SEQ ID NO: 337 - DNA, 384 bp, Artificial Sequence
  Description of Artificial Sequence: Synthetic heavy chain variable region
caggtccagcttgtacagtctgggggaggcttggtaaagcctggggggtcccttagactctcatgtgcagcctctggattcactttcagtaacgcctggatgagctgggtccgccaggctccagggaaggggctggactgggttggccgtatcaaaaccaaagctgatggtgggacaagagactacgctgcacccgtgaaaggcagatttaccatctcgagagatgattcagaaaacacgttgtatctgcaaatgaccagcctgaaaaccgaggacacaggcgtgtattactgtagcacaggcccaccctataaatatcatgatagtactggttattcggtcgttgactactggggccagggaaccctggtcactgtctcctca

SEQ ID NO: 338 - protein, 128 aa, Artificial Sequence
  Description of Artificial Sequence: Synthetic heavy chain variable region
QVQLVQSGGGLVKPGGSLRLSCAASGFTFSNAWMSWVRQAPGKGLDWVGRIKTKADGGTRDYAAPVKGRFTISRDDSENTLYLQMTSLKTEDTGVYYCSTGPPYKYHDSTGYSVVDYWGQGTLVTVSS

SEQ ID NO: 339 - protein, 9 aa, Artificial Sequence
  Description of Artificial Sequence: Synthetic heavy chain variable region CDR H1
FTFSNAWMS

SEQ ID NO: 340 - DNA, 27 bp, Artificial Sequence
  Description of Artificial Sequence: Synthetic heavy chain variable region CDR H1
ttcactttcagtaacgcctggatgagc

SEQ ID NO: 341 - protein, 19 aa, Artificial Sequence
  Description of Artificial Sequence: Synthetic heavy chain variable region CDR H2
RIKTKADGGTRDYAAPVKG

SEQ ID NO: 342 - DNA, 57 bp, Artificial Sequence
  Description of Artificial Sequence: Synthetic heavy chain variable region CDR H2
cgtatcaaaaccaaagctgatggtgggacaagagactacgctgcacccgtgaaaggc

SEQ ID NO: 343 - protein, 19 aa, Artificial Sequence
  Description of Artificial Sequence: Synthetic heavy chain variable region CDR H3
STGPPYKYHDSTGYSVVDY

SEQ ID NO: 344 - DNA, 57 bp, Artificial Sequence
  Description of Artificial Sequence: Synthetic heavy chain variable region CDR H3
agcacaggcccaccctataaatatcatgatagtactggttattcggtcgttgactac

SEQ ID NO: 345 - DNA, 330 bp, Artificial Sequence
  Description of Artificial Sequence: Synthetic light chain variable region
tcttatgagctgactcagccaccctcagcgtctgggacccccgggcagagggtcaccatctcctgttctggaggcagctccaacatcggaagtgattatgtatactggtaccagcagctcccaggaacggcccccaaactcctcatctatggtagtagtcagcgaccctcaggggtccctgaccgattctctggctcccagtctggcacctcagcctccctggccatcagtggtctccggtccgaggatgaggctgattattactgtgctatgtgggatgacagcctgaatggtccggtgttcggcggagggaccaagctgaccgtccta

SEQ ID NO: 346 - protein, 110 aa, Artificial Sequence
  Description of Artificial Sequence: Synthetic light chain variable region
SYELTQPPSASGTPGQRVTISCSGGSSNIGSDYVYWYQQLPGTAPKLLIYGSSQRPSGVPDRFSGSQSGTSASLAISGLRSEDEADYYCAMWDDSLNGPVFGGGTKLTVL

SEQ ID NO: 347 - protein, 13 aa, Artificial Sequence
  Description of Artificial Sequence: Synthetic light chain variable region CDR L1
SGGSSNIGSDYVY

SEQ ID NO: 348 - DNA, 39 bp, Artificial Sequence
  Description of Artificial Sequence: Synthetic light chain variable region CDR L1
tctggaggcagctccaacatcggaagtgattatgtatac

SEQ ID NO: 349 - protein, 7 aa, Artificial Sequence
  Description of Artificial Sequence: Synthetic light chain variable region CDR L2
GSSQRPS

SEQ ID NO: 350 - DNA, 21 bp, Artificial Sequence
  Description of Artificial Sequence: Synthetic light chain variable region CDR L2
ggtagtagtcagcgaccctca

SEQ ID NO: 351 - protein, 11 aa, Artificial Sequence
  Description of Artificial Sequence: Synthetic light chain variable region CDR L3
AMWDDSLNGPV

SEQ ID NO: 352 - DNA, 33 bp, Artificial Sequence
  Description of Artificial Sequence: Synthetic light chain variable region CDR L3
gctatgtgggatgacagcctgaatggtccggtg

SEQ ID NO: 353 - DNA, 378 bp, Artificial Sequence
  Description of Artificial Sequence: Synthetic heavy chain variable region
caggtgcagctacagcagtggggcgcaggactgttgaagccttcggagaccctgtccctctcctgcaccgtctctggtggggtcttcggcaattacttttggagttgggtccgccaggccccagggaagggcctggaatggattggagaaatcaatcagattggaaccaccaactacagtccgtccgcgtccctcaagagtcgagtcactatatcagttgacccgtccaggaaccagttctccctgagcctgaggtctgtgaccgccgcggacacggctcggtattactgtacgagatccgaaacttcagattactttgatagtagtggttatgcatttcatatctggggcgaagggacaatggtcaccgtctcttca

SEQ ID NO: 354 - protein, 126 aa, Artificial Sequence
  Description of Artificial Sequence: Synthetic heavy chain variable region
QVQLQQWGAGLLKPSETLSLSCTVSGGVFGNYFWSWVRQAPGKGLEWIGEINQIGTTNYSPSASLKSRVTISVDPSRNQFSLSLRSVTAADTARYYCTRSETSDYFDSSGYAFHIWGEGTMVTVSS

SEQ ID NO: 355 - protein, 9 aa, Artificial Sequence
  Description of Artificial Sequence: Synthetic heavy chain variable region CDR H1
GVFGNYFWS

SEQ ID NO: 356 - DNA, 27 bp, Artificial Sequence
  Description of Artificial Sequence: Synthetic heavy chain variable region CDR H1
ggggtcttcggcaattacttttggagt

SEQ ID NO: 357 - protein, 18 aa, Artificial Sequence
  Description of Artificial Sequence: Synthetic heavy chain variable region CDR H2
EINQIGTTNYSPSASLKS

SEQ ID NO: 358 - DNA, 54 bp, Artificial Sequence
  Description of Artificial Sequence: Synthetic heavy chain variable region CDR H2
gaaatcaatcagattggaaccaccaactacagtccgtccgcgtccctcaagagt

SEQ ID NO: 359 - protein, 18 aa, Artificial Sequence
  Description of Artificial Sequence: Synthetic heavy chain variable region CDR H3
TRSETSDYFDSSGYAFHI

SEQ ID NO: 360 - DNA, 54 bp, Artificial Sequence
  Description of Artificial Sequence: Synthetic heavy chain variable region CDR H3
acgagatccgaaacttcagattactttgatagtagtggttatgcatttcatatc

SEQ ID NO: 361 - DNA, 327 bp, Artificial Sequence
  Description of Artificial Sequence: Synthetic light chain variable region
ctgcctgtgctgactcagcctgcctccgtgtctgggtctcctggacagtcgatcaccatctcctgcagtggaatcagcagtgacggtggtcgctataactatgtgtcctggtaccaacaacacccgggcaaagcccccaaactcctcatctatgatgacagtaattggcctttaggggtttctcatcgcttctctgggtccaagtctggcaacacggcctccctgaccatctctgggctccgggctgaggacgaggcggactattattgcggctcatatacggacaccaacagactcttcggcggaggcacccagctgaccgtcctc

SEQ ID NO: 362 - protein, 109 aa, Artificial Sequence
  Description of Artificial Sequence: Synthetic light chain variable region
LPVLTQPASVSGSPGQSITISCSGISSDGGRYNYVSWYQQHPGKAPKLLIYDDSNWPLGVSHRFSGSKSGNTASLTISGLRAEDEADYYCGSYTDTNRLFGGGTQLTVL

SEQ ID NO: 363 - protein, 14 aa, Artificial Sequence
  Description of Artificial Sequence: Synthetic light chain variable region CDR L1
SGISSDGGRYNYVS

SEQ ID NO: 364 - DNA, 42 bp, Artificial Sequence
  Description of Artificial Sequence: Synthetic light chain variable region CDR L1
agtggaatcagcagtgacggtggtcgctataactatgtgtcc

SEQ ID NO: 365 - protein, 7 aa, Artificial Sequence
  Description of Artificial Sequence: Synthetic light chain variable region CDR L2
DDSNWPL

SEQ ID NO: 366 - DNA, 21 bp, Artificial Sequence
  Description of Artificial Sequence: Synthetic light chain variable region CDR L2
gatgacagtaattggccttta

SEQ ID NO: 367 - protein, 9 aa, Artificial Sequence
  Description of Artificial Sequence: Synthetic light chain variable region CDR L3
GSYTDTNRL

SEQ ID NO: 368 - DNA, 27 bp, Artificial Sequence
  Description of Artificial Sequence: Synthetic light chain variable region CDR L3
ggctcatatacggacaccaacagactc

SEQ ID NO: 369 - DNA, 351 bp, Artificial Sequence
  Description of Artificial Sequence: Synthetic heavy chain variable region
gaggtgcagctggtggagtcggggggaggcgtggtccagcctgggaggtccctgagactctcctgtgcagcctctggattcaccttcagtgaccatgctatgtactgggtccgccaggctccaggcaaagggctagagtgggtggcacttatatcatttgatggaaggaatatatactacgcagactccgtgaagggccgattcaccatctccagagacaattccaagaacacgctgtatctgcagatgaacagcctgagagctgaggacacggctgtctattactgtgcgagagatcaatggctggttcctgactactggggccagggaaccctggtcaccgtctcctca

SEQ ID NO: 370 - protein, 117 aa, Artificial Sequence
  Description of Artificial Sequence: Synthetic heavy chain variable region
EVQLVESGGGVVQPGRSLRLSCAASGFTFSDHAMYWVRQAPGKGLEWVALISFDGRNIYYADSVKGRFTISRDNSKNTLYLQMNSLRAEDTAVYYCARDQWLVPDYWGQGTLVTVSS

SEQ ID NO: 371 - protein, 9 aa, Artificial Sequence
  Description of Artificial Sequence: Synthetic heavy chain variable region CDR H1
FTFSDHAMY

SEQ ID NO: 372 - DNA, 27 bp, Artificial Sequence
  Description of Artificial Sequence: Synthetic heavy chain variable region CDR H1
ttcaccttcagtgaccatgctatgtac

SEQ ID NO: 373 - protein, 17 aa, Artificial Sequence
  Description of Artificial Sequence: Synthetic heavy chain variable region CDR H2
LISFDGRNIYYADSVKG

SEQ ID NO: 374 - DNA, 51 bp, Artificial Sequence
  Description of Artificial Sequence: Synthetic heavy chain variable region CDR H2
cttatatcatttgatggaaggaatatatactacgcagactccgtgaagggc

SEQ ID NO: 375 - protein, 10 aa, Artificial Sequence
  Description of Artificial Sequence: Synthetic heavy chain variable region CDR H3
ARDQWLVPDY

SEQ ID NO: 376 - DNA, 30 bp, Artificial Sequence
  Description of Artificial Sequence: Synthetic heavy chain variable region CDR H3
gcgagagatcaatggctggttcctgactac

SEQ ID NO: 377 - DNA, 327 bp, Artificial Sequence
  Description of Artificial Sequence: Synthetic light chain variable region
ctgcctgtgctgactcagcctgcctccgtgtctgggtctcctggacagtcgatcaccatctcctgcactggaaccagcagtgacgttggtggttataactatgtctcctggtaccaacagcacccaggcaacgcccccaaactcatgatttatgaagtcagtaagcggccctcaggggtccctgatcgcttctctggcttcaagtctggcaacacggcctccctgaccgtctctgggctccaggctgaggatgaggctgattattactgcagctcatatgcaggcagcaacagtgtcttcggaactgggaccaagctcaccgtccta

SEQ ID NO: 378 - protein, 109 aa, Artificial Sequence
  Description of Artificial Sequence: Synthetic light chain variable region
LPVLTQPASVSGSPGQSITISCTGTSSDVGGYNYVSWYQQHPGNAPKLMIYEVSKRPSGVPDRFSGFKSGNTASLTVSGLQAEDEADYYCSSYAGSNSVFGTGTKLTVL

SEQ ID NO: 379 - protein, 14 aa, Artificial Sequence
  Description of Artificial Sequence: Synthetic light chain variable region CDR L1
TGTSSDVGGYNYVS

SEQ ID NO: 380 - DNA, 42 bp, Artificial Sequence
  Description of Artificial Sequence: Synthetic light chain variable region CDR L1
actggaaccagcagtgacgttggtggttataactatgtctcc

SEQ ID NO: 381 - protein, 7 aa, Artificial Sequence
  Description of Artificial Sequence: Synthetic light chain variable region CDR L2
EVSKRPS

SEQ ID NO: 382 - DNA, 21 bp, Artificial Sequence
  Description of Artificial Sequence: Synthetic light chain variable region CDR L2
gaagtcagtaagcggccctca

SEQ ID NO: 383 - protein, 9 aa, Artificial Sequence
  Description of Artificial Sequence: Synthetic light chain variable region CDR L3
SSYAGSNSV

SEQ ID NO: 384 - DNA, 27 bp, Artificial Sequence
  Description of Artificial Sequence: Synthetic light chain variable region CDR L3
agctcatatgcaggcagcaacagtgtc

SEQ ID NO: 385 - DNA, 366 bp, Artificial Sequence
  Description of Artificial Sequence: Synthetic heavy chain variable region
caggtccagctggtgcagtctgggggaggcgtggtccagcctggggggtccctgagactctcctgtgcagcgtatggactcaccttcagggcctatggcatgcactgggtccgccaggctccaggcaaggggctcgagtgggtggcagtgtcatggtatgacggaacaaatgaagtctatgcagactcagtgaagggccgcttcagaatctccagagatgattccaggagcactctatatttgcaaatgaatagtctgagaggcgaggacacggctgtatattactgtgcgacagaaaggatgtgggaggaaaactccagcagcttcggctggtggggccggggaaccctggtcaccgtctcctca

SEQ ID NO: 386 - protein, 122 aa, Artificial Sequence
  Description of Artificial Sequence: Synthetic heavy chain variable region
QVQLVQSGGGVVQPGGSLRLSCAAYGLTFRAYGMHWVRQAPGKGLEWVAVSWYDGTNEVYADSVKGRFRISRDDSRSTLYLQMNSLRGEDTAVYYCATERMWEENSSSFGWWGRGTLVTVSS

SEQ ID NO: 387 - protein, 9 aa, Artificial Sequence
  Description of Artificial Sequence: Synthetic heavy chain variable region CDR H1
LTFRAYGMH

SEQ ID NO: 388 - DNA, 27 bp, Artificial Sequence
  Description of Artificial Sequence: Synthetic heavy chain variable region CDR H1
ctcaccttcagggcctatggcatgcac

SEQ ID NO: 389 - protein, 17 aa, Artificial Sequence
  Description of Artificial Sequence: Synthetic heavy chain variable region CDR H2
VSWYDGTNEVYADSVKG

SEQ ID NO: 390 - DNA, 51 bp, Artificial Sequence
  Description of Artificial Sequence: Synthetic heavy chain variable region CDR H2
gtgtcatggtatgacggaacaaatgaagtctatgcagactcagtgaagggc

SEQ ID NO: 391 - protein, 15 aa, Artificial Sequence
  Description of Artificial Sequence: Synthetic heavy chain variable region CDR H3
ATERMWEENSSSFGW

SEQ ID NO: 392 - DNA, 45 bp, Artificial Sequence
  Description of Artificial Sequence: Synthetic heavy chain variable region CDR H3
gcgacagaaaggatgtgggaggaaaactccagcagcttcggctgg

SEQ ID NO: 393 - DNA, 330 bp, Artificial Sequence
  Description of Artificial Sequence: Synthetic light chain variable region
caggctgtgctgactcagcctgcctccgtgtctgggtctcctggacagtcgatcaccatttcctgcactggaagcagcagtgacgttggtggttctaactttgtctcctggtaccaacaacacccaggcaaagcccccaaactcatggtttatgatgtcaatcatcggccctcagggatttctaatcgcttctctggctccaagtctggcaacacggcctccctgaccatctctgggctccaggctgaggacgaggctgattattactgcacctcatatacaagtagaagctcttatgtcttcggaagtgggaccaaggtgaccgtactt

SEQ ID NO: 394 - protein, 110 aa, Artificial Sequence
  Description of Artificial Sequence: Synthetic light chain variable region
QAVLTQPASVSGSPGQSITISCTGSSSDVGGSNFVSWYQQHPGKAPKLMVYDVNHRPSGISNRFSGSKSGNTASLTISGLQAEDEADYYCTSYTSRSSYVFGSGTKVTVL

SEQ ID NO: 395 - protein, 14 aa, Artificial Sequence
  Description of Artificial Sequence: Synthetic light chain variable region CDR L1
TGSSSDVGGSNFVS

SEQ ID NO: 396 - DNA, 42 bp, Artificial Sequence
  Description of Artificial Sequence: Synthetic light chain variable region CDR L1
actggaagcagcagtgacgttggtggttctaactttgtctcc

SEQ ID NO: 397 - protein, 7 aa, Artificial Sequence
  Description of Artificial Sequence: Synthetic light chain variable region CDR L2
DVNHRPS

SEQ ID NO: 398 - DNA, 21 bp, Artificial Sequence
  Description of Artificial Sequence: Synthetic light chain variable region CDR L2
gatgtcaatcatcggccctca

SEQ ID NO: 399 - protein, 10 aa, Artificial Sequence
  Description of Artificial Sequence: Synthetic light chain variable region CDR L3
TSYTSRSSYV

SEQ ID NO: 400 - DNA, 30 bp, Artificial Sequence
  Description of Artificial Sequence: Synthetic light chain variable region CDR L3
acctcatatacaagtagaagctcttatgtc

SEQ ID NO: 401 - DNA, 363 bp, Artificial Sequence
  Description of Artificial Sequence: Synthetic heavy chain variable region
caggtccagctggtacagtctggaactgaagtgaagaagcctggggcctcagtgaaggtctcctgtaaggcctctgggtacatcttcgaccactttgctatcacctgggtgcgccaggcccctggacaagggcctgagtggatgggatggatcagcgcttataatgggagaacagaggattcagggaaattcccgggcagactcaccctgaccacagaccccgccacgcggacagccttcctggaactgaggggcctgacacctgacgacacggccgtttattactgtgcgcgagatgtcccggtcatgggagccgcatttttggactactggggccagggaaccctggtcaccgtctcctca

SEQ ID NO: 402 - protein, 121 aa, Artificial Sequence
  Description of Artificial Sequence: Synthetic heavy chain variable region
QVQLVQSGTEVKKPGASVKVSCKASGYIFDHFAITWVRQAPGQGPEWMGWISAYNGRTEDSGKFPGRLTLTTDPATRTAFLELRGLTPDDTAVYYCARDVPVMGAAFLDYWGQGTLVTVSS

SEQ ID NO: 403 - protein, 9 aa, Artificial Sequence
  Description of Artificial Sequence: Synthetic heavy chain variable region CDR H1
YIFDHFAIT

SEQ ID NO: 404 - DNA, 27 bp, Artificial Sequence
  Description of Artificial Sequence: Synthetic heavy chain variable region CDR H1
tacatcttcgaccactttgctatcacc

SEQ ID NO: 405 - protein, 17 aa, Artificial Sequence
  Description of Artificial Sequence: Synthetic heavy chain variable region CDR H2
WISAYNGRTEDSGKFPG

SEQ ID NO: 406 - DNA, 51 bp, Artificial Sequence
  Description of Artificial Sequence: Synthetic heavy chain variable region CDR H2
tggatcagcgcttataatgggagaacagaggattcagggaaattcccgggc

SEQ ID NO: 407 - protein, 14 aa, Artificial Sequence
  Description of Artificial Sequence: Synthetic heavy chain variable region CDR H3
ARDVPVMGAAFLDY

SEQ ID NO: 408 - DNA, 42 bp, Artificial Sequence
  Description of Artificial Sequence: Synthetic heavy chain variable region CDR H3
gcgcgagatgtcccggtcatgggagccgcatttttggactac

SEQ ID NO: 409 - DNA, 336 bp, Artificial Sequence
  Description of Artificial Sequence: Synthetic light chain variable region
gaaattgtattgacacagtctccactctccctgcccgtcactgttggacagccggcctccatctcctgcaggtctggccaaagtctcgaattcagtgatggaaacacctacttgacttggtttcaccagaggccaggccaatctccaaggcgcctaatttataggggttcttaccgggactctggggtccccgacagattccgcggcagtggctcaggcactactttcacactgacaatcagcagggtggaggctgaggatgttgggatttatttctgcatgcaaggtacacactggcctccgaccttcggccaagggaccaaagtggatatcaaa

SEQ ID NO: 410 - protein, 112 aa, Artificial Sequence
  Description of Artificial Sequence: Synthetic light chain variable region
EIVLTQSPLSLPVTVGQPASISCRSGQSLEFSDGNTYLTWFHQRPGQSPRRLIYRGSYRDSGVPDRFRGSGSGTTFTLTISRVEAEDVGIYFCMQGTHWPPTFGQGTKVDIK

SEQ ID NO: 411 - protein, 16 aa, Artificial Sequence
  Description of Artificial Sequence: Synthetic light chain variable region CDR L1
RSGQSLEFSDGNTYLT

SEQ ID NO: 412 - DNA, 48 bp, Artificial Sequence
  Description of Artificial Sequence: Synthetic light chain variable region CDR L1
aggtctggccaaagtctcgaattcagtgatggaaacacctacttgact

SEQ ID NO: 413 - protein, 7 aa, Artificial Sequence
  Description of Artificial Sequence: Synthetic light chain variable region CDR L2
RGSYRDS

SEQ ID NO: 414 - DNA, 21 bp, Artificial Sequence
  Description of Artificial Sequence: Synthetic light chain variable region CDR L2
aggggttcttaccgggactct

SEQ ID NO: 415 - protein, 9 aa, Artificial Sequence
  Description of Artificial Sequence: Synthetic light chain variable region CDR L3
MQGTHWPPT

SEQ ID NO: 416 - DNA, 27 bp, Artificial Sequence
  Description of Artificial Sequence: Synthetic light chain variable region CDR L3
atgcaaggtacacactggcctccgacc

SEQ ID NO: 417 - DNA, 372 bp, Artificial Sequence
  Description of Artificial Sequence: Synthetic heavy chain variable region
caggtccagctggtgcagtctggggctgaggtgaagaagcctggggcctcagtgaaagtctcctgtgaggcctctgcatacagtttcagcggcgactatgttcactgggtgcgacaggcccctggacaagggcttgagtggatgggttggataaaggctgtcaatggtggcgcaaactatgcacagaggtttcacggcagggtcaccatgaccactgactcgtccaggagcacagtctatctggagctgaccaggctgacacctgacgacacggccgtttatttttgtgcgaaagatcgagctgcaagtgttcatgtgccagctggtgagtttgacctctggggccagggaaccctggtcaccgtctcctca

SEQ ID NO: 418 - protein, 124 aa, Artificial Sequence
  Description of Artificial Sequence: Synthetic heavy chain variable region
QVQLVQSGAEVKKPGASVKVSCEASAYSFSGDYVHWVRQAPGQGLEWMGWIKAVNGGANYAQRFHGRVTMTTDSSRSTVYLELTRLTPDDTAVYFCAKDRAASVHVPAGEFDLWGQGTLVTVSS

SEQ ID NO: 419 - protein, 9 aa, Artificial Sequence
  Description of Artificial Sequence: Synthetic heavy chain variable region CDR H1
YSFSGDYVH

SEQ ID NO: 420 - DNA, 27 bp, Artificial Sequence
  Description of Artificial Sequence: Synthetic heavy chain variable region CDR H1
tacagtttcagcggcgactatgttcac

SEQ ID NO: 421 - protein, 17 aa, Artificial Sequence
  Description of Artificial Sequence: Synthetic heavy chain variable region CDR H2
WIKAVNGGANYAQRFHG

SEQ ID NO: 422 - DNA, 51 bp, Artificial Sequence
  Description of Artificial Sequence: Synthetic heavy chain variable region CDR H2
tggataaaggctgtcaatggtggcgcaaactatgcacagaggtttcacggc

SEQ ID NO: 423 - protein, 17 aa, Artificial Sequence
  Description of Artificial Sequence: Synthetic heavy chain variable region CDR H3
AKDRAASVHVPAGEFDL

SEQ ID NO: 424 - DNA, 51 bp, Artificial Sequence
  Description of Artificial Sequence: Synthetic heavy chain variable region CDR H3
gcgaaagatcgagctgcaagtgttcatgtgccagctggtgagtttgacctc

SEQ ID NO: 425 - DNA, 324 bp, Artificial Sequence
  Description of Artificial Sequence: Synthetic light chain variable region
gacatccaggtgacccagtctccttcctccctgtctgcatctgtaggagacagagtcagcatcacttgtcgggcaagtcagagcattagcaactttttaaattggtatcggcagagaccagggaaagcccctgagctcctaatctatgctgcctccactttgcaaggtggggtcccatcaaggttcagtggcagtggatctgggacacatttcactctcaccatcagcagtctccagcctgaagattttgcaacttactactgtcaacagagttacactattccttcgatcaccttcggccaagggacacgactggagattaaa

SEQ ID NO: 426 - protein, 108 aa, Artificial Sequence
  Description of Artificial Sequence: Synthetic light chain variable region
DIQVTQSPSSLSASVGDRVSITCRASQSISNFLNWYRQRPGKAPELLIYAASTLQGGVPSRFSGSGSGTHFTLTISSLQPEDFATYYCQQSYTIPSITFGQGTRLEIK

SEQ ID NO: 427 - protein, 11 aa, Artificial Sequence
  Description of Artificial Sequence: Synthetic light chain variable region CDR L1
RASQSISNFLN

SEQ ID NO: 428 - DNA, 33 bp, Artificial Sequence
  Description of Artificial Sequence: Synthetic light chain variable region CDR L1
cgggcaagtcagagcattagcaactttttaaat

SEQ ID NO: 429 - protein, 7 aa, Artificial Sequence
  Description of Artificial Sequence: Synthetic light chain variable region CDR L2
AASTLQG

SEQ ID NO: 430 - DNA, 21 bp, Artificial Sequence
  Description of Artificial Sequence: Synthetic light chain variable region CDR L2
gctgcctccactttgcaaggt

SEQ ID NO: 431 - protein, 10 aa, Artificial Sequence
  Description of Artificial Sequence: Synthetic light chain variable region CDR L3
QQSYTIPSIT

SEQ ID NO: 432 - DNA, 30 bp, Artificial Sequence
  Description of Artificial Sequence: Synthetic light chain variable region CDR L3
caacagagttacactattccttcgatcacc

SEQ ID NO: 433 - DNA, 366 bp, Artificial Sequence
  Description of Artificial Sequence: Synthetic heavy chain variable region
caggtgcagctgttggagtcgggcgcaggacttttgaagccttcggagaccctgtccctcacctgctctttgtctggtgggtccttcagagacttctactgggcctggattcgccaggcccccgggagggggctggagtggattggggacatcaatgacggtggaaacaccaaccacagtccgtccctcaagagtcgagccatcctttccatagacgcgtccaagaggcagttctccctgagactgacctctgtgaccgccgcggacacggctgtttattattgcgcgagacagaggctcgaacacacggcatctggatattacatggacgtctggggcaacgggaccacggtcaccgtctcctca

SEQ ID NO: 434 - protein, 122 aa, Artificial Sequence
  Description of Artificial Sequence: Synthetic heavy chain variable region
QVQLLESGAGLLKPSETLSLTCSLSGGSFRDFYWAWIRQAPGRGLEWIGDINDGGNTNHSPSLKSRAILSIDASKRQFSLRLTSVTAADTAVYYCARQRLEHTASGYYMDVWGNGTTVTVSS

SEQ ID NO: 435 - protein, 9 aa, Artificial Sequence
  Description of Artificial Sequence: Synthetic heavy chain variable region CDR H1
GSFRDFYWA

SEQ ID NO: 436 - DNA, 27 bp, Artificial Sequence
  Description of Artificial Sequence: Synthetic heavy chain variable region CDR H1
gggtccttcagagacttctactgggcc

SEQ ID NO: 437 - protein, 16 aa, Artificial Sequence
  Description of Artificial Sequence: Synthetic heavy chain variable region CDR H2
DINDGGNTNHSPSLKS

SEQ ID NO: 438 - DNA, 48 bp, Artificial Sequence
  Description of Artificial Sequence: Synthetic heavy chain variable region CDR H2
gacatcaatgacggtggaaacaccaaccacagtccgtccctcaagagt

SEQ ID NO: 439 - protein, 16 aa, Artificial Sequence
  Description of Artificial Sequence: Synthetic heavy chain variable region CDR H3
ARQRLEHTASGYYMDV

SEQ ID NO: 440 - DNA, 48 bp, Artificial Sequence
  Description of Artificial Sequence: Synthetic heavy chain variable region CDR H3
gcgagacagaggctcgaacacacggcatctggatattacatggacgtc

SEQ ID NO: 441 - DNA, 324 bp, Artificial Sequence
  Description of Artificial Sequence: Synthetic light chain variable region
cagtctgtcctgacgcagccgccctcggtgtcagtggacccaggagagacggccaccattacctgtggcggagccaacattggttctaaaaatgtctactggtatcagcagaggccaggccaggcccctgtgctggtcgtctatgatgatatcgaccggcccgcagggatccctgatcgattcactgactctagttctgggaacacggtcaccctgaccatctacagcgtcgaggccgtggatgaggccgactatttctgtcaggtgtgggataattcttctgatcagccggtgttcggcggagggaccaagctcaccgtcctc

SEQ ID NO: 442 - protein, 108 aa, Artificial Sequence
  Description of Artificial Sequence: Synthetic light chain variable region
QSVLTQPPSVSVDPGETATITCGGANIGSKNVYWYQQRPGQAPVLVVYDDIDRPAGIPDRFTDSSSGNTVTLTIYSVEAVDEADYFCQVWDNSSDQPVFGGGTKLTVL

SEQ ID NO: 443 - protein, 11 aa, Artificial Sequence
  Description of Artificial Sequence: Synthetic light chain variable region CDR L1
GGANIGSKNVY

SEQ ID NO: 444 - DNA, 33 bp, Artificial Sequence
  Description of Artificial Sequence: Synthetic light chain variable region CDR L1
ggcggagccaacattggttctaaaaatgtctac

SEQ ID NO: 445 - protein, 7 aa, Artificial Sequence
  Description of Artificial Sequence: Synthetic light chain variable region CDR L2
DDIDRPA

SEQ ID NO: 446 - DNA, 21 bp, Artificial Sequence
  Description of Artificial Sequence: Synthetic light chain variable region CDR L2
gatgatatcgaccggcccgca

SEQ ID NO: 447 - protein, 11 aa, Artificial Sequence
  Description of Artificial Sequence: Synthetic light chain variable region CDR L3
QVWDNSSDQPV

SEQ ID NO: 448 - DNA, 33 bp, Artificial Sequence
  Description of Artificial Sequence: Synthetic light chain variable region CDR L3
caggtgtgggataattcttctgatcagccggtg

SEQ ID NO: 449 - DNA, 357 bp, Artificial Sequence
  Description of Artificial Sequence: Synthetic heavy chain variable region
caggtccagcttgtgcagtctggagcagaggcgaaaaagcccggggagcctctgaggatctcctgtaagggttctggatacacctttagcagctactggatcagctgggtgcgccagaggcccggggaacgcctggagtggatggggagaattgatccgagtgactcctatgcctactcgagcccgtccttccaaggccacgtcaccttctcagctgacaagtccagcaacactgcctttttgcagtggagcagcctgcaggcctcggacaccgccatctattactgcgcgagacacaaagagaattacgatttttgggatttctggggccagggcacaatggtcaccgtctcttca

SEQ ID NO: 450 - protein, 119 aa, Artificial Sequence
  Description of Artificial Sequence: Synthetic heavy chain variable region
QVQLVQSGAEAKKPGEPLRISCKGSGYTFSSYWISWVRQRPGERLEWMGRIDPSDSYAYSSPSFQGHVTFSADKSSNTAFLQWSSLQASDTAIYYCARHKENYDFWDFWGQGTMVTVSS

SEQ ID NO: 451 - protein, 9 aa, Artificial Sequence
  Description of Artificial Sequence: Synthetic heavy chain variable region CDR H1
YTFSSYWIS

SEQ ID NO: 452 - DNA, 27 bp, Artificial Sequence
  Description of Artificial Sequence: Synthetic heavy chain variable region CDR H1
tacacctttagcagctactggatcagc

SEQ ID NO: 453 - protein, 17 aa, Artificial Sequence
  Description of Artificial Sequence: Synthetic heavy chain variable region CDR H2
RIDPSDSYAYSSPSFQG

SEQ ID NO: 454 - DNA, 51 bp, Artificial Sequence
  Description of Artificial Sequence: Synthetic heavy chain variable region CDR H2
agaattgatccgagtgactcctatgcctactcgagcccgtccttccaaggc

SEQ ID NO: 455 - protein, 12 aa, Artificial Sequence
  Description of Artificial Sequence: Synthetic heavy chain variable region CDR H3
ARHKENYDFWDF

SEQ ID NO: 456 - DNA, 36 bp, Artificial Sequence
  Description of Artificial Sequence: Synthetic heavy chain variable region CDR H3
gcgagacacaaagagaattacgatttttgggatttc

SEQ ID NO: 457 - DNA, 336 bp, Artificial Sequence
  Description of Artificial Sequence: Synthetic light chain variable region
gaaacgacactcacgcagtctccagactccctggctgtgtccctgggcgagagggccaccatcaactgcaggtccagccagcctattttgttcaaccccatcaataaactctccttagcttggtaccagctcaaaccaggacagcctcctaagctgctcatttcctgggcatctacccgggaacccggggtccctgaccgattcaatggcagcgggtctgggacagttttcactctcaccatcagcagcctgcagcctgaagatgtggcagtttatgtctgtcagcaatattttactagtacttttttcggccctgggaccaaggtggaaatcaaa

SEQ ID NO: 458 - protein, 112 aa, Artificial Sequence
  Description of Artificial Sequence: Synthetic light chain variable region
ETTLTQSPDSLAVSLGERATINCRSSQPILFNPINKLSLAWYQLKPGQPPKLLISWASTREPGVPDRFNGSGSGTVFTLTISSLQPEDVAVYVCQQYFTSTFFGPGTKVEIK

SEQ ID NO: 459 - protein, 17 aa, Artificial Sequence
  Description of Artificial Sequence: Synthetic light chain variable region CDR L1
RSSQPILFNPINKLSLA

SEQ ID NO: 460 - DNA, 51 bp, Artificial Sequence
  Description of Artificial Sequence: Synthetic light chain variable region CDR L1
aggtccagccagcctattttgttcaaccccatcaataaactctccttagct

SEQ ID NO: 461 - protein, 7 aa, Artificial Sequence
  Description of Artificial Sequence: Synthetic light chain variable region CDR L2
WASTREP

SEQ ID NO: 462 - DNA, 21 bp, Artificial Sequence
  Description of Artificial Sequence: Synthetic light chain variable region CDR L2
tgggcatctacccgggaaccc

SEQ ID NO: 463 - protein, 8 aa, Artificial Sequence
  Description of Artificial Sequence: Synthetic light chain variable region CDR L3
QQYFTSTF

SEQ ID NO: 464 - DNA, 24 bp, Artificial Sequence
  Description of Artificial Sequence: Synthetic light chain variable region CDR L3
cagcaatattttactagtactttt

SEQ ID NO: 465 - DNA, 366 bp, Artificial Sequence
  Description of Artificial Sequence: Synthetic heavy chain variable region
gaggtgcagctgttggagtctggaagtgaggtgaagaagcctgggacctcagtgaaggtctcctgcgagacttctggttacatctttaccaactatgctatctcctgggtgcgacaggcccctggacagggtcttgagtggctgggttggatcagtggttacaatggtcagacctactatgcgcagaaggtccagggtagactcaccctgaccacagacacgtccacgatgacagcctacatggacctgacgagccttagatctgacgacacggccatttattattgtgtgagagatgtccccgtgatttcaggcgcttccacaatggactactggggccagggaaccctggtcaccgtctcctca

SEQ ID NO: 466 - protein, 122 aa, Artificial Sequence
  Description of Artificial Sequence: Synthetic heavy chain variable region
EVQLLESGSEVKKPGTSVKVSCETSGYIFTNYAISWVRQAPGQGLEWLGWISGYNGQTYYAQKVQGRLTLTTDTSTMTAYMDLTSLRSDDTAIYYCVRDVPVISGASTMDYWGQGTLVTVSS

SEQ ID NO: 467 - protein, 9 aa, Artificial Sequence
  Description of Artificial Sequence: Synthetic heavy chain variable region CDR H1
YIFTNYAIS

SEQ ID NO: 468 - DNA, 27 bp, Artificial Sequence
  Description of Artificial Sequence: Synthetic heavy chain variable region CDR H1
tacatctttaccaactatgctatctcc

SEQ ID NO: 469 - protein, 17 aa, Artificial Sequence
  Description of Artificial Sequence: Synthetic heavy chain variable region CDR H2
WISGYNGQTYYAQKVQG

SEQ ID NO: 470 - DNA, 51 bp, Artificial Sequence
  Description of Artificial Sequence: Synthetic heavy chain variable region CDR H2
tggatcagtggttacaatggtcagacctactatgcgcagaaggtccagggt

SEQ ID NO: 471 - protein, 15 aa, Artificial Sequence
  Description of Artificial Sequence: Synthetic heavy chain variable region CDR H3
VRDVPVISGASTMDY

SEQ ID NO: 472 - DNA, 45 bp, Artificial Sequence
  Description of Artificial Sequence: Synthetic heavy chain variable region CDR H3
gtgagagatgtccccgtgatttcaggcgcttccacaatggactac

SEQ ID NO: 473 - DNA, 336 bp, Artificial Sequence
  Description of Artificial Sequence: Synthetic light chain variable region
gatattgtgatgacgcagtctccactctccctgcccgtcacccatggacagccggcctccatctcctgcaggtctagtcaaagcctcgtttacagcgatggaaacacctacttgagttggtttcagctgaggccaggccaatctccaaggcgcctaatttataaggtttctaaccgggactctggggtcccagacagattcagcggcagtgggtcaggcactgatttcacactgaaaatcagccgggtggaggctgaggatgttggagtttattactgcatgcaagctacacagtggcctcgaacgttcggccaagggaccaaggtggagatcaaa

SEQ ID NO: 474 - protein, 112 aa, Artificial Sequence
  Description of Artificial Sequence: Synthetic light chain variable region
DIVMTQSPLSLPVTHGQPASISCRSSQSLVYSDGNTYLSWFQLRPGQSPRRLIYKVSNRDSGVPDRFSGSGSGTDFTLKISRVEAEDVGVYYCMQATQWPRTFGQGTKVEIK

SEQ ID NO: 475 - protein, 16 aa, Artificial Sequence
  Description of Artificial Sequence: Synthetic light chain variable region CDR L1
RSSQSLVYSDGNTYLS

SEQ ID NO: 476 - DNA, 48 bp, Artificial Sequence
  Description of Artificial Sequence: Synthetic light chain variable region CDR L1
aggtctagtcaaagcctcgtttacagcgatggaaacacctacttgagt

SEQ ID NO: 477 - protein, 7 aa, Artificial Sequence
  Description of Artificial Sequence: Synthetic light chain variable region CDR L2
KVSNRDS

SEQ ID NO: 478 - DNA, 21 bp, Artificial Sequence
  Description of Artificial Sequence: Synthetic light chain variable region CDR L2
aaggtttctaaccgggactct

SEQ ID NO: 479 - protein, 9 aa, Artificial Sequence
  Description of Artificial Sequence: Synthetic light chain variable region CDR L3
MQATQWPRT

SEQ ID NO: 480 - DNA, 27 bp, Artificial Sequence
  Description of Artificial Sequence: Synthetic light chain variable region CDR L3
atgcaagctacacagtggcctcgaacg

SEQ ID NO: 481 - DNA, 378 bp, Artificial Sequence
  Description of Artificial Sequence: Synthetic heavy chain variable region
caggtccagcttgtacagtctggtcctacgctggtgaggcccacacagaccctcacgctgacttgcaccttctctgggttctcactctctactcgtggcgtgggcgtgggctgggtccgtcagtccccaggaaaggccccggagttccttgttctcgctcattgggatgatgataagatctacagtccatctctcaggcgcagactctccgtcaccaaggatgtctccaaaaaccaggtggtccttgccttgaccaacgtggaccctgtggacacaggcacatatttctgtgtcaagagcgatctctatgatagaggtggctattacttatattactttgatcattggggtcagggaaccctggtcaccgtctcctca

SEQ ID NO: 482 - protein, 126 aa, Artificial Sequence
  Description of Artificial Sequence: Synthetic heavy chain variable region
QVQLVQSGPTLVRPTQTLTLTCTFSGFSLSTRGVGVGWVRQSPGKAPEFLVLAHWDDDKIYSPSLRRRLSVTKDVSKNQVVLALTNVDPVDTGTYFCVKSDLYDRGGYYLYYFDHWGQGTLVTVSS

SEQ ID NO: 483 - protein, 11 aa, Artificial Sequence
  Description of Artificial Sequence: Synthetic heavy chain variable region CDR H1
FSLSTRGVGVG

SEQ ID NO: 484 - DNA, 33 bp, Artificial Sequence
  Description of Artificial Sequence: Synthetic heavy chain variable region CDR H1
ttctcactctctactcgtggcgtgggcgtgggc

SEQ ID NO: 485 - protein, 16 aa, Artificial Sequence
  Description of Artificial Sequence: Synthetic heavy chain variable region CDR H2
LAHWDDDKIYSPSLRR

SEQ ID NO: 486 - DNA, 48 bp, Artificial Sequence
  Description of Artificial Sequence: Synthetic heavy chain variable region CDR H2
ctcgctcattgggatgatgataagatctacagtccatctctcaggcgc

SEQ ID NO: 487 - protein, 18 aa, Artificial Sequence
  Description of Artificial Sequence: Synthetic heavy chain variable region CDR H3
VKSDLYDRGGYYLYYFDH

SEQ ID NO: 488 - DNA, 54 bp, Artificial Sequence
  Description of Artificial Sequence: Synthetic heavy chain variable region CDR H3
gtcaagagcgatctctatgatagaggtggctattacttatattactttgatcat

SEQ ID NO: 489 - DNA, 321 bp, Artificial Sequence
  Description of Artificial Sequence: Synthetic light chain variable region
gacatccggatgacccagtctccatcctccctgtctgcatctgtgggggacagagtcaccatcacttgccgggcaagtcagaccattgccagttatgtgaattggtatctgcaaagaccaggggaagcccctaaactcctgatctatgcagcttccaatttgcacagtggggccccaccgtcactcattggcaggggctctgggacagatttcactctcaccatcaacactctgcaacctgaacattttggaacttacttctgtcagcagactttctcctctccatacacttttggccaggggaccaaggtggaaatcaaa

SEQ ID NO: 490 - protein, 107 aa, Artificial Sequence
  Description of Artificial Sequence: Synthetic light chain variable region
DIRMTQSPSSLSASVGDRVTITCRASQTIASYVNWYLQRPGEAPKLLIYAASNLHSGAPPSLIGRGSGTDFTLTINTLQPEHFGTYFCQQTFSSPYTFGQGTKVEIK

SEQ ID NO: 491 - protein, 11 aa, Artificial Sequence
  Description of Artificial Sequence: Synthetic light chain variable region CDR L1
RASQTIASYVN

SEQ ID NO: 492 - DNA, 33 bp, Artificial Sequence
  Description of Artificial Sequence: Synthetic light chain variable region CDR L1
cgggcaagtcagaccattgccagttatgtgaat

SEQ ID NO: 493 - protein, 7 aa, Artificial Sequence
  Description of Artificial Sequence: Synthetic light chain variable region CDR L2
AASNLHS

SEQ ID NO: 494 - DNA, 21 bp, Artificial Sequence
  Description of Artificial Sequence: Synthetic light chain variable region CDR L2
gcagcttccaatttgcacagt

SEQ ID NO: 495 - protein, 9 aa, Artificial Sequence
  Description of Artificial Sequence: Synthetic light chain variable region CDR L3
QQTFSSPYT

SEQ ID NO: 496 - DNA, 27 bp, Artificial Sequence
  Description of Artificial Sequence: Synthetic light chain variable region CDR L3
cagcagactttctcctctccatacact

SEQ ID NO: 497 - DNA, 378 bp, Artificial Sequence
  Description of Artificial Sequence: Synthetic heavy chain variable region
caggtgcagctggtggagtctggtcctacgctggtgaagcccacacagaccctcacgctgacctgcaccttctctgggttctcactcactactcgtggcgtgggtgtgggctgggtccgtcagcccccaggaaaggccctggagttccttggactcactcattgggatgatgataagatctacagcccatctctcaggcgcagactcaccatcaccaaggacacctccaaaaaccaggtggtccttgcattggccaacgtggaccctgtggacacagccacatatttctgtgtaaaaagcgatctctatgatagaggtggttattacttatactactttgactattggggtcagggaaccctggtcaccgtctcctca

SEQ ID NO: 498 - protein, 126 aa, Artificial Sequence
  Description of Artificial Sequence: Synthetic heavy chain variable region
QVQLVESGPTLVKPTQTLTLTCTFSGFSLTTRGVGVGWVRQPPGKALEFLGLTHWDDDKIYSPSLRRRLTITKDTSKNQVVLALANVDPVDTATYFCVKSDLYDRGGYYLYYFDYWGQGTLVTVSS

SEQ ID NO: 499 - protein, 11 aa, Artificial Sequence
  Description of Artificial Sequence: Synthetic heavy chain variable region CDR H1
FSLTTRGVGVG

SEQ ID NO: 500 - DNA, 33 bp, Artificial Sequence
  Description of Artificial Sequence: Synthetic heavy chain variable region CDR H1
ttctcactcactactcgtggcgtgggtgtgggc

SEQ ID NO: 501 - protein, 16 aa, Artificial Sequence
  Description of Artificial Sequence: Synthetic heavy chain variable region CDR H2
LTHWDDDKIYSPSLRR

SEQ ID NO: 502 - DNA, 48 bp, Artificial Sequence
  Description of Artificial Sequence: Synthetic heavy chain variable region CDR H2
ctcactcattgggatgatgataagatctacagcccatctctcaggcgc

SEQ ID NO: 503 - protein, 18 aa, Artificial Sequence
  Description of Artificial Sequence: Synthetic heavy chain variable region CDR H3
VKSDLYDRGGYYLYYFDY

SEQ ID NO: 504 - DNA, 54 bp, Artificial Sequence
  Description of Artificial Sequence: Synthetic heavy chain variable region CDR H3
gtaaaaagcgatctctatgatagaggtggttattacttatactactttgactat

SEQ ID NO: 505 - DNA, 321 bp, Artificial Sequence
  Description of Artificial Sequence: Synthetic light chain variable region
gaaattgtgttgacacagtctccatcctccctgtctgcatctgtgggggacagagtcaccatcacttgccgggcaagtcagaccattcccagttatgtaaattggtatctgcaaagaccaggggaagcccctaaactcctgatctatggtgcttccaatttgcacactggggccccaccaacattcattggcaggggatctggggcagatttcactctcaccatcaacactctgcaacctgaacattttggaacctactactgtcaacagactttctcctctccatacacttttggccaggggaccaaggtggaaatcaaa

SEQ ID NO: 506 - protein, 107 aa, Artificial Sequence
  Description of Artificial Sequence: Synthetic light chain variable region
EIVLTQSPSSLSASVGDRVTITCRASQTIPSYVNWYLQRPGEAPKLLIYGASNLHTGAPPTFIGRGSGADFTLTINTLQPEHFGTYYCQQTFSSPYTFGQGTKVEIK

SEQ ID NO: 507 - protein, 11 aa, Artificial Sequence
  Description of Artificial Sequence: Synthetic light chain variable region CDR L1
RASQTIPSYVN

SEQ ID NO: 508 - DNA, 33 bp, Artificial Sequence
  Description of Artificial Sequence: Synthetic light chain variable region CDR L1
cgggcaagtcagaccattcccagttatgtaaat

SEQ ID NO: 509 - protein, 7 aa, Artificial Sequence
  Description of Artificial Sequence: Synthetic light chain variable region CDR L2
GASNLHT

SEQ ID NO: 510 - DNA, 21 bp, Artificial Sequence
  Description of Artificial Sequence: Synthetic light chain variable region CDR L2
ggtgcttccaatttgcacact

SEQ ID NO: 511 - protein, 9 aa, Artificial Sequence
  Description of Artificial Sequence: Synthetic light chain variable region CDR L3
QQTFSSPYT

SEQ ID NO: 512 - DNA, 27 bp, Artificial Sequence
  Description of Artificial Sequence: Synthetic light chain variable region CDR L3
caacagactttctcctctccatacact

SEQ ID NO: 513 - DNA, 378 bp, Artificial Sequence
  Description of Artificial Sequence: Synthetic heavy chain variable region
caggtcaccttgaaggagtctggtcctgcgctggtgaaacccacagagaccctcacactgacctgtaccttctctggcttctcactcagcactaaaagactgagtgtgagttggatccgtcagcccccagggaaggccctggagtggcttgctcgcatagattgggatgatgataaatcttacagcacatctctgaggaccaggctcaccatcgccaaggacacttccaaaaaccaggtcgtccttacaatgaccaacatgggccccgcggacacagccacctatttctgtgttcggtcttctgtatatgctagtaatgcttattacctctactactttgactcttggggccagggaaccctggtcaccgtctcctca

SEQ ID NO: 514 - protein, 126 aa, Artificial Sequence
  Description of Artificial Sequence: Synthetic heavy chain variable region
QVTLKESGPALVKPTETLTLTCTFSGFSLSTKRLSVSWIRQPPGKALEWLARIDWDDDKSYSTSLRTRLTIAKDTSKNQVVLTMTNMGPADTATYFCVRSSVYASNAYYLYYFDSWGQGTLVTVSS

SEQ ID NO: 515 - protein, 11 aa, Artificial Sequence
  Description of Artificial Sequence: Synthetic heavy chain variable region CDR H1
FSLSTKRLSVS

SEQ ID NO: 516 - DNA, 33 bp, Artificial Sequence
  Description of Artificial Sequence: Synthetic heavy chain variable region CDR H1
ttctcactcagcactaaaagactgagtgtgagt

SEQ ID NO: 517 - protein, 16 aa, Artificial Sequence
  Description of Artificial Sequence: Synthetic heavy chain variable region CDR H2
RIDWDDDKSYSTSLRT

SEQ ID NO: 518 - DNA, 48 bp, Artificial Sequence
  Description of Artificial Sequence: Synthetic heavy chain variable region CDR H2
cgcatagattgggatgatgataaatcttacagcacatctctgaggacc

SEQ ID NO: 519 - protein, 18 aa, Artificial Sequence
  Description of Artificial Sequence: Synthetic heavy chain variable region CDR H3
VRSSVYASNAYYLYYFDS

SEQ ID NO: 520 - DNA, 54 bp, Artificial Sequence
  Description of Artificial Sequence: Synthetic heavy chain variable region CDR H3
gttcggtcttctgtatatgctagtaatgcttattacctctactactttgactct

SEQ ID NO: 521 - DNA, 321 bp, Artificial Sequence
  Description of Artificial Sequence: Synthetic light chain variable region
gacatccggatgacccagtctccatcttccctgtctgcatctgtcggagacagagtcaccatcacttgccgggcaagtcagagcattgccacctacttaaattggtatcagcacaaaccagggaaagcccctaccctcctgatctatgctgcatccattttgcacagtggtgtcccgccaaggttcagtggccgtgcctctgggacagatttcactctcaccatcagcagtctgcaacctgaagattttgcaacttactactgtcaacaggcctacagttccccttacacttttggccaggggaccaaagtggatatcaaa

SEQ ID NO: 522 - protein, 107 aa, Artificial Sequence
  Description of Artificial Sequence: Synthetic light chain variable region
DIRMTQSPSSLSASVGDRVTITCRASQSIATYLNWYQHKPGKAPTLLIYAASILHSGVPPRFSGRASGTDFTLTISSLQPEDFATYYCQQAYSSPYTFGQGTKVDIK

SEQ ID NO: 523 - protein, 11 aa, Artificial Sequence
  Description of Artificial Sequence: Synthetic light chain variable region CDR L1
RASQSIATYLN

SEQ ID NO: 524 - DNA, 33 bp, Artificial Sequence
  Description of Artificial Sequence: Synthetic light chain variable region CDR L1
cgggcaagtcagagcattgccacctacttaaat

SEQ ID NO: 525 - protein, 7 aa, Artificial Sequence
  Description of Artificial Sequence: Synthetic light chain variable region CDR L2
AASILHS

SEQ ID NO: 526 - DNA, 21 bp, Artificial Sequence
  Description of Artificial Sequence: Synthetic light chain variable region CDR L2
gctgcatccattttgcacagt

SEQ ID NO: 527 - protein, 9 aa, Artificial Sequence
  Description of Artificial Sequence: Synthetic light chain variable region CDR L3
QQAYSSPYT

SEQ ID NO: 528 - DNA, 27 bp, Artificial Sequence
  Description of Artificial Sequence: Synthetic light chain variable region CDR L3
caacaggcctacagttccccttacact

SEQ ID NO: 529 - DNA, 378 bp, Artificial Sequence
  Description of Artificial Sequence: Synthetic heavy chain variable region
caggtccagctggtgcagtctggggctgaggtgaagaagcctgggtcctcagtgaaggtctcctgcaaggcttctggaggcaccttcggcagctatgctgtcatctgggtgcgacaggcccctggacaagggcttgagtggatgggacatatcatccctgtttttgggacaataaacaacgcacagaagttccagggcagactcacccttagcgcagacgaatccacgggcacagtctacatggggctgagcagcctgagatctgacgacacggccgtgtatttctgtgcgaccaagagatattgtagtgatcccagctgccatggactctggtacttcgatctctggggccgtggcaccctggtcaccgtctcctca

SEQ ID NO: 530 - protein, 126 aa, Artificial Sequence
  Description of Artificial Sequence: Synthetic heavy chain variable region
QVQLVQSGAEVKKPGSSVKVSCKASGGTFGSYAVIWVRQAPGQGLEWMGHIIPVFGTINNAQKFQGRLTLSADESTGTVYMGLSSLRSDDTAVYFCATKRYCSDPSCHGLWYFDLWGRGTLVTVSS

SEQ ID NO: 531 - protein, 9 aa, Artificial Sequence
  Description of Artificial Sequence: Synthetic heavy chain variable region CDR H1
GTFGSYAVI

SEQ ID NO: 532 - DNA, 27 bp, Artificial Sequence
  Description of Artificial Sequence: Synthetic heavy chain variable region CDR H1
ggcaccttcggcagctatgctgtcatc

SEQ ID NO: 533 - protein, 17 aa, Artificial Sequence
  Description of Artificial Sequence: Synthetic heavy chain variable region CDR H2
HIIPVFGTINNAQKFQG

SEQ ID NO: 534 - DNA, 51 bp, Artificial Sequence
  Description of Artificial Sequence: Synthetic heavy chain variable region CDR H2
catatcatccctgtttttgggacaataaacaacgcacagaagttccagggc

SEQ ID NO: 535 - protein, 19 aa, Artificial Sequence
  Description of Artificial Sequence: Synthetic heavy chain variable region CDR H3
ATKRYCSDPSCHGLWYFDL

SEQ ID NO: 536 - DNA, 57 bp, Artificial Sequence; identical to SEQ ID NO: 88
  Description of Artificial Sequence: Synthetic heavy chain variable region CDR H3

SEQ ID NO: 537 - DNA, 339 bp, Artificial Sequence
  Description of Artificial Sequence: Synthetic light chain variable region
gacatccggttgacccagtctccactctccctgcccgtcacccctggagagccggcctccatctcctgcaggtctagtcagagcctcttggatagtgatgatggaaacacctatttggactggtacctgcagaagccagggcagtctccacaggtcctgatctatatgctttcgtatcgggcctctggagtcccagacaggttcagtggcagtgggtcaggcactgatttcacactgaaaatcagcagggtggaggctgaggatgttggagtttattactgcatgcaacgtgcagagtttccttacacttttggccaggggaccaagctggagatcaaa

SEQ ID NO: 538 - protein, 113 aa, Artificial Sequence
  Description of Artificial Sequence: Synthetic light chain variable region
DIRLTQSPLSLPVTPGEPASISCRSSQSLLDSDDGNTYLDWYLQKPGQSPQVLIYMLSYRASGVPDRFSGSGSGTDFTLKISRVEAEDVGVYYCMQRAEFPYTFGQGTKLEIK

SEQ ID NO: 539 - protein, 17 aa, Artificial Sequence
  Description of Artificial Sequence: Synthetic light chain variable region CDR L1
RSSQSLLDSDDGNTYLD

SEQ ID NO: 540 - DNA, 51 bp, Artificial Sequence; identical to SEQ ID NO: 92
  Description of Artificial Sequence: Synthetic light chain variable region CDR L1

SEQ ID NO: 541 - protein, 7 aa, Artificial Sequence
  Description of Artificial Sequence: Synthetic light chain variable region CDR L2
MLSYRAS

SEQ ID NO: 542 - DNA, 21 bp, Artificial Sequence
  Description of Artificial Sequence: Synthetic light chain variable region CDR L2
atgctttcgtatcgggcctct

SEQ ID NO: 543 - protein, 9 aa, Artificial Sequence
  Description of Artificial Sequence: Synthetic light chain variable region CDR L3
MQRAEFPYT

SEQ ID NO: 544 - DNA, 27 bp, Artificial Sequence
  Description of Artificial Sequence: Synthetic light chain variable region CDR L3
atgcaacgtgcagagtttccttacact

SEQ ID NO: 545 - DNA, 357 bp, Artificial Sequence
  Description of Artificial Sequence: Synthetic heavy chain variable region
caggtccagcttgtgcagtctggagcagaggtgaaaaagcccggggagcctctgaggatctcctgtaagggttctggatacacctttaccagctactggatcagttgggtgcgccagatgcccgggacaggccttgagtggatggggagaattgatccgagtgactcctatacctactcgagcccgtccttccaaggccacgtcaccatctcagttgacaagtccatcagcactgcctacctgcaatggagcagcctgaaggcctcggacaccgccatatattactgtgcgagacacaaagagaattacgatttttgggatttttggggccagggaaccctggtcaccgtctcctca

SEQ ID NO: 546 - protein, 119 aa, Artificial Sequence
  Description of Artificial Sequence: Synthetic heavy chain variable region
QVQLVQSGAEVKKPGEPLRISCKGSGYTFTSYWISWVRQMPGTGLEWMGRIDPSDSYTYSSPSFQGHVTISVDKSISTAYLQWSSLKASDTAIYYCARHKENYDFWDFWGQGTLVTVSS

SEQ ID NO: 547 - protein, 9 aa, Artificial Sequence
  Description of Artificial Sequence: Synthetic heavy chain variable region CDR H1
YTFTSYWIS

SEQ ID NO: 548 - DNA, 27 bp, Artificial Sequence
  Description of Artificial Sequence: Synthetic heavy chain variable region CDR H1
tacacctttaccagctactggatcagt

SEQ ID NO: 549 - protein, 17 aa, Artificial Sequence
  Description of Artificial Sequence: Synthetic heavy chain variable region CDR H2
RIDPSDSYTYSSPSFQG

SEQ ID NO: 550 - DNA, 51 bp, Artificial Sequence
  Description of Artificial Sequence: Synthetic heavy chain variable region CDR H2
agaattgatccgagtgactcctatacctactcgagcccgtccttccaaggc

SEQ ID NO: 551 - protein, 12 aa, Artificial Sequence
  Description of Artificial Sequence: Synthetic heavy chain variable region CDR H3
ARHKENYDFWDF

SEQ ID NO: 552 - DNA, 36 bp, Artificial Sequence
  Description of Artificial Sequence: Synthetic heavy chain variable region CDR H3
gcgagacacaaagagaattacgatttttgggatttt

SEQ ID NO: 553 - DNA, 336 bp, Artificial Sequence
  Description of Artificial Sequence: Synthetic light chain variable region
gaaacgacactcacgcagtctccagactccctggctgtgtccctgggcgagagggccaccatcaactgcaagtccagccagactattttcttcaactccaataataagatctccttagcttggtaccagcagaaaccaggacagcctcctaagctgctcatttcctgggcatctacccgcgaatccggggtccctgaccgattcagtggcagcgggtctgggacagatttcactctcaccatcagcagcctgcagcctgaggatgtggcagtttatttctgtcagcaatattatagtagtgcttttttcggccctgggacacgactggagattaaa

SEQ ID NO: 554 - protein, 112 aa, Artificial Sequence
  Description of Artificial Sequence: Synthetic light chain variable region
ETTLTQSPDSLAVSLGERATINCKSSQTIFFNSNNKISLAWYQQKPGQPPKLLISWASTRESGVPDRFSGSGSGTDFTLTISSLQPEDVAVYFCQQYYSSAFFGPGTRLEIK

SEQ ID NO: 555 - protein, 17 aa, Artificial Sequence
  Description of Artificial Sequence: Synthetic light chain variable region CDR L1
KSSQTIFFNSNNKISLA

SEQ ID NO: 556 - DNA, 51 bp, Artificial Sequence
  Description of Artificial Sequence: Synthetic light chain variable region CDR L1
aagtccagccagactattttcttcaactccaataataagatctccttagct

SEQ ID NO: 557 - protein, 7 aa, Artificial Sequence
  Description of Artificial Sequence: Synthetic light chain variable region CDR L2
WASTRES

SEQ ID NO: 558 - DNA, 21 bp, Artificial Sequence
  Description of Artificial Sequence: Synthetic light chain variable region CDR L2
tgggcatctacccgcgaatcc

SEQ ID NO: 559 - protein, 8 aa, Artificial Sequence
  Description of Artificial Sequence: Synthetic light chain variable region CDR L3
QQYYSSAF

SEQ ID NO: 560 - DNA, 24 bp, Artificial Sequence
  Description of Artificial Sequence: Synthetic light chain variable region CDR L3
cagcaatattatagtagtgctttt

SEQ ID NO: 561 - DNA, 363 bp, Artificial Sequence
  Description of Artificial Sequence: Synthetic heavy chain variable region
caggtccagctggtgcagtctggacctgaagtgaagaagcctggggcctcagtgacgatctcctgtcaggcctctgggtacatcttcaatcactactctatcacctgggtgcgacaggcccctggacaagggactgagtggatggggtggatcagcgcctatcacggtaagacggaatattcagggaaattccacggcagagtcaccctgaccacagacacaggcacgcggacagccttcttggaacttagggacctgacatctgacgacacggccatttattattgtgcgcgagatgtcccggtcatgggagccgcatttttggactactggggccagggaaccctggtcaccgtctcctca

SEQ ID NO: 562 - protein, 121 aa, Artificial Sequence
  Description of Artificial Sequence: Synthetic heavy chain variable region
QVQLVQSGPEVKKPGASVTISCQASGYIFNHYSITWVRQAPGQGTEWMGWISAYHGKTEYSGKFHGRVTLTTDTGTRTAFLELRDLTSDDTAIYYCARDVPVMGAAFLDYWGQGTLVTVSS

SEQ ID NO: 563 - protein, 9 aa, Artificial Sequence
  Description of Artificial Sequence: Synthetic heavy chain variable region CDR H1
YIFNHYSIT

SEQ ID NO: 564 - DNA, 27 bp, Artificial Sequence
  Description of Artificial Sequence: Synthetic heavy chain variable region CDR H1
tacatcttcaatcactactctatcacc

SEQ ID NO: 565 - protein, 17 aa, Artificial Sequence
  Description of Artificial Sequence: Synthetic heavy chain variable region CDR H2
WISAYHGKTEYSGKFHG

SEQ ID NO: 566 - DNA, 51 bp, Artificial Sequence
  Description of Artificial Sequence: Synthetic heavy chain variable region CDR H2
tggatcagcgcctatcacggtaagacggaatattcagggaaattccacggc

SEQ ID NO: 567 - protein, 14 aa, Artificial Sequence
  Description of Artificial Sequence: Synthetic heavy chain variable region CDR H3
ARDVPVMGAAFLDY

SEQ ID NO: 568 - DNA, 42 bp, Artificial Sequence; identical to SEQ ID NO: 408
  Description of Artificial Sequence: Synthetic heavy chain variable region CDR H3

SEQ ID NO: 569 - DNA, 336 bp, Artificial Sequence
  Description of Artificial Sequence: Synthetic light chain variable region
gaaattgtgttgacacagtctccactctccctgcccgtcacccttggacagccggcctccatctcctgcaggtctggtcaaagtctcgaattcagtgatggaaacacctacttgacttggtttcagcagaggccaggccaatctccaaggcgcctaatttttaggggttcttaccgggactctggggtccccgaaagattcagcggcagtggctcaggcacttctttcacactgacaatcagcagggtggaggctgaggatgttgggatttatttctgcatgcaaggtacacactggcctccgacgttcggccaagggaccaagctggagatcaaa

SEQ ID NO: 570 - protein, 112 aa, Artificial Sequence
  Description of Artificial Sequence: Synthetic light chain variable region
EIVLTQSPLSLPVTLGQPASISCRSGQSLEFSDGNTYLTWFQQRPGQSPRRLIFRGSYRDSGVPERFSGSGSGTSFTLTISRVEAEDVGIYFCMQGTHWPPTFGQGTKLEIK

SEQ ID NO: 571 - protein, 16 aa, Artificial Sequence
  Description of Artificial Sequence: Synthetic light chain variable region CDR L1
RSGQSLEFSDGNTYLT

SEQ ID NO: 572 - DNA, 48 bp, Artificial Sequence
  Description of Artificial Sequence: Synthetic light chain variable region CDR L1
aggtctggtcaaagtctcgaattcagtgatggaaacacctacttgact

SEQ ID NO: 573 - protein, 7 aa, Artificial Sequence
  Description of Artificial Sequence: Synthetic light chain variable region CDR L2
RGSYRDS

SEQ ID NO: 574 - DNA, 21 bp, Artificial Sequence
  Description of Artificial Sequence: Synthetic light chain variable region CDR L2
aggggttcttaccgggactct

SEQ ID NO: 575 - protein, 9 aa, Artificial Sequence
  Description of Artificial Sequence: Synthetic light chain variable region CDR L3
MQGTHWPPT

SEQ ID NO: 576 - DNA, 27 bp, Artificial Sequence
  Description of Artificial Sequence: Synthetic light chain variable region CDR L3
atgcaaggtacacactggcctccgacg

SEQ ID NO: 577 - DNA, 378 bp, Artificial Sequence
  Description of Artificial Sequence: Synthetic heavy chain variable region
caggtgcagctggtgcagtctggccctgcgctggtgaaacccacgcagaccctcacactgacctgcaccttctctgggttctcactcaccactgcaagaatgtgtgtgagttggatccgtcagcccccagggaaggccctggagtggcttgcacgcattgattgggatgatgataaatcctacagcacatctctgaagaccaggctcaccatcgccaaggacacatccaaaaaccaggtcgtccttaccatgaccaacatgggccccgcggacacagccacttattactgtgtacggactcctatatatgctagtggtggttattacctctcctactttgactcctggggccagggaaccctggtcaccgtctcctca

SEQ ID NO: 578 - protein, 126 aa, Artificial Sequence
  Description of Artificial Sequence: Synthetic heavy chain variable region
QVQLVQSGPALVKPTQTLTLTCTFSGFSLTTARMCVSWIRQPPGKALEWLARIDWDDDKSYSTSLKTRLTIAKDTSKNQVVLTMTNMGPADTATYYCVRTPIYASGGYYLSYFDSWGQGTLVTVSS

SEQ ID NO: 579 - protein, 11 aa, Artificial Sequence
  Description of Artificial Sequence: Synthetic heavy chain variable region CDR H1
FSLTTARMCVS

SEQ ID NO: 580 - DNA, 33 bp, Artificial Sequence
  Description of Artificial Sequence: Synthetic heavy chain variable region CDR H1
ttctcactcaccactgcaagaatgtgtgtgagt

SEQ ID NO: 581 - protein, 16 aa, Artificial Sequence
  Description of Artificial Sequence: Synthetic heavy chain variable region CDR H2
RIDWDDDKSYSTSLKT

SEQ ID NO: 582 - DNA, 48 bp, Artificial Sequence
  Description of Artificial Sequence: Synthetic heavy chain variable region CDR H2
cgcattgattgggatgatgataaatcctacagcacatctctgaagacc

SEQ ID NO: 583 - protein, 18 aa, Artificial Sequence
  Description of Artificial Sequence: Synthetic heavy chain variable region CDR H3
VRTPIYASGGYYLSYFDS

SEQ ID NO: 584 - DNA, 54 bp, Artificial Sequence
  Description of Artificial Sequence: Synthetic heavy chain variable region CDR H3
gtacggactcctatatatgctagtggtggttattacctctcctactttgactcc

SEQ ID NO: 585 - DNA, 321 bp, Artificial Sequence
  Description of Artificial Sequence: Synthetic light chain variable region
gatattgtgatgacgcagtctccatcctccctgtctgcatctgtcggagacagcgtcaccatcacttgccgggcaagtcagactattgccagctatgtgaattggtatcagcacaaaccagggcaagcccctaacctcctgatctatgctgcatccattttgcacagtggggtcccatcaaggttcagaggcggtggctctgggacagatttcactctcaccatcaacagtctgcaacctgaagattttgcaacttactactgtcaacagagttacagtaccccttacacttttggccaggggaccaaagtggatatcaaa

SEQ ID NO: 586 - protein, 107 aa, Artificial Sequence
  Description of Artificial Sequence: Synthetic light chain variable region
DIVMTQSPSSLSASVGDSVTITCRASQTIASYVNWYQHKPGQAPNLLIYAASILHSGVPSRFRGGGSGTDFTLTINSLQPEDFATYYCQQSYSTPYTFGQGTKVDIK

SEQ ID NO: 587 - protein, 11 aa, Artificial Sequence
  Description of Artificial Sequence: Synthetic light chain variable region CDR L1
RASQTIASYVN

SEQ ID NO: 588 - DNA, 33 bp, Artificial Sequence
  Description of Artificial Sequence: Synthetic light chain variable region CDR L1
cgggcaagtcagactattgccagctatgtgaat

SEQ ID NO: 589 - protein, 7 aa, Artificial Sequence
  Description of Artificial Sequence: Synthetic light chain variable region CDR L2
AASILHS

SEQ ID NO: 590 - DNA, 21 bp, Artificial Sequence
  Description of Artificial Sequence: Synthetic light chain variable region CDR L2
gctgcatccattttgcacagt

SEQ ID NO: 591 - protein, 9 aa, Artificial Sequence
  Description of Artificial Sequence: Synthetic light chain variable region CDR L3
QQSYSTPYT

SEQ ID NO: 592 - DNA, 27 bp, Artificial Sequence
  Description of Artificial Sequence: Synthetic light chain variable region CDR L3
caacagagttacagtaccccttacact

SEQ ID NO: 593 - DNA, 378 bp, Artificial Sequence
  Description of Artificial Sequence: Synthetic heavy chain variable region
caggtgcagctggtggagtctggtcctacgctggtgaaacccacacagaccctctcgctgacctgcaccttctctgggttctcactcaccactcgtggagtgggtgtgggctggatccgtcagcccccaggaaaggccctggagtggcttggattcacttattgggatggtgatgaccgctacagcccatctctgaggaacagagtctccatcgccaaggacacctccaaaaaccaggtggtccttacactgaccaacatggaccctgtggacacagccacgtatttttgtgtacacagcgatcgctatgacaggggtggttattacttatacttctttgactactggggcccgggaaccctggtcaccgtctcctca

SEQ ID NO: 594 - protein, 126 aa, Artificial Sequence
  Description of Artificial Sequence: Synthetic heavy chain variable region
QVQLVESGPTLVKPTQTLSLTCTFSGFSLTTRGVGVGWIRQPPGKALEWLGFTYWDGDDRYSPSLRNRVSIAKDTSKNQVVLTLTNMDPVDTATYFCVHSDRYDRGGYYLYFFDYWGPGTLVTVSS

SEQ ID NO: 595 - protein, 11 aa, Artificial Sequence
  Description of Artificial Sequence: Synthetic heavy chain variable region CDR H1
FSLTTRGVGVG

SEQ ID NO: 596 - DNA, 33 bp, Artificial Sequence
  Description of Artificial Sequence: Synthetic heavy chain variable region CDR H1
ttctcactcaccactcgtggagtgggtgtgggc

SEQ ID NO: 597 - protein, 16 aa, Artificial Sequence
  Description of Artificial Sequence: Synthetic heavy chain variable region CDR H2
FTYWDGDDRYSPSLRN

SEQ ID NO: 598 - DNA, 48 bp, Artificial Sequence
  Description of Artificial Sequence: Synthetic heavy chain variable region CDR H2
ttcacttattgggatggtgatgaccgctacagcccatctctgaggaac

SEQ ID NO: 599 - protein, 18 aa, Artificial Sequence
  Description of Artificial Sequence: Synthetic heavy chain variable region CDR H3
VHSDRYDRGGYYLYFFDY

SEQ ID NO: 600 - DNA, 54 bp, Artificial Sequence
  Description of Artificial Sequence: Synthetic heavy chain variable region CDR H3
gtacacagcgatcgctatgacaggggtggttattacttatacttctttgactac

SEQ ID NO: 601 - DNA, 321 bp, Artificial Sequence
  Description of Artificial Sequence: Synthetic light chain variable region
gacatccgagtcacccagtctccatcctccctgtctgcgtctgtgggggacagagtctccatcagttgccgggcaagtcagaccattgccagttatgtaaattggtatcagcagagaccagggaaagcccctcaactcctgatctttgctgcatcccatttgcagactggggtcccatcaagattcagtggcaggggctctgggacagatttcactctcaccatcacctctctgcaacctgaagattttgcaacttactactgtcaacagagttacacttccccgtacacttttggccaggggaccaaggtggaaatcaaa

SEQ ID NO: 602 - protein, 107 aa, Artificial Sequence
  Description of Artificial Sequence: Synthetic light chain variable region
DIRVTQSPSSLSASVGDRVSISCRASQTIASYVNWYQQRPGKAPQLLIFAASHLQTGVPSRFSGRGSGTDFTLTITSLQPEDFATYYCQQSYTSPYTFGQGTKVEIK

SEQ ID NO: 603 - protein, 11 aa, Artificial Sequence
  Description of Artificial Sequence: Synthetic light chain variable region CDR L1
RASQTIASYVN

SEQ ID NO: 604 - DNA, 33 bp, Artificial Sequence
  Description of Artificial Sequence: Synthetic light chain variable region CDR L1
cgggcaagtcagaccattgccagttatgtaaat

SEQ ID NO: 605 - protein, 7 aa, Artificial Sequence
  Description of Artificial Sequence: Synthetic light chain variable region CDR L2
AASHLQT

SEQ ID NO: 606 - DNA, 21 bp, Artificial Sequence
  Description of Artificial Sequence: Synthetic light chain variable region CDR L2
gctgcatcccatttgcagact

SEQ ID NO: 607 - protein, 9 aa, Artificial Sequence
  Description of Artificial Sequence: Synthetic light chain variable region CDR L3
QQSYTSPYT

SEQ ID NO: 608 - DNA, 27 bp, Artificial Sequence
  Description of Artificial Sequence: Synthetic light chain variable region CDR L3
caacagagttacacttccccgtacact

SEQ ID NO: 609 - DNA, 378 bp, Artificial Sequence
  Description of Artificial Sequence: Synthetic heavy chain variable region
gaggtgcagctggtggagtctggtcctacgctggtgaaacccacacagaccctcacgctgacctgctccctctctgggttctcactcaccactcgtggggtgggtgtgggctggatccgccagcccccaggaaaggccccggagtgccttggattcgtttattgggatgatgataaccgctacagcccatctctgaggggcagactcaccatctccaaggacacgtccaagaaccaggtggtccttacactgaccaacatggaccctttggacacagccacctattactgtgttcacagcgatctctatgatagaggtggttattacttattctactttgacgactggggccagggaaccctggtcaccgtctcctca

SEQ ID NO: 610 - protein, 126 aa, Artificial Sequence
  Description of Artificial Sequence: Synthetic heavy chain variable region
EVQLVESGPTLVKPTQTLTLTCSLSGFSLTTRGVGVGWIRQPPGKAPECLGFVYWDDDNRYSPSLRGRLTISKDTSKNQVVLTLTNMDPLDTATYYCVHSDLYDRGGYYLFYFDDWGQGTLVTVSS

SEQ ID NO: 611 - protein, 11 aa, Artificial Sequence
  Description of Artificial Sequence: Synthetic heavy chain variable region CDR H1
FSLTTRGVGVG

SEQ ID NO: 612 - DNA, 33 bp, Artificial Sequence
  Description of Artificial Sequence: Synthetic heavy chain variable region CDR H1
ttctcactcaccactcgtggggtgggtgtgggc

SEQ ID NO: 613 - protein, 16 aa, Artificial Sequence
  Description of Artificial Sequence: Synthetic heavy chain variable region CDR H2
FVYWDDDNRYSPSLRG

SEQ ID NO: 614 - DNA, 48 bp, Artificial Sequence
  Description of Artificial Sequence: Synthetic heavy chain variable region CDR H2
ttcgtttattgggatgatgataaccgctacagcccatctctgaggggc

SEQ ID NO: 615 - protein, 18 aa, Artificial Sequence
  Description of Artificial Sequence: Synthetic heavy chain variable region CDR H3
VHSDLYDRGGYYLFYFDD

SEQ ID NO: 616 - DNA, 54 bp, Artificial Sequence
  Description of Artificial Sequence: Synthetic heavy chain variable region CDR H3
gttcacagcgatctctatgatagaggtggttattacttattctactttgacgac

SEQ ID NO: 617 - DNA, 321 bp, Artificial Sequence
  Description of Artificial Sequence: Synthetic light chain variable region
gacatccaggtgacccagtctccatcctccctgtctgcatctgtgggggacagagtcaccatcacttgccgggcaagtcagcccattgccagttatttaaattggtatcagcagaaaccagggcaagcccctaaactcctcatctatgctgcatccatgttgcagagtggggccccatcaaaattcagtggccggggatctgggacagatttcactctcaccatcaccactctacaacctgaagattttgcaacttactactgtcaacagagttacactttcccgtacacttttggccaggggaccaaggtggaaatcaaa

SEQ ID NO: 618 - protein, 107 aa, Artificial Sequence
  Description of Artificial Sequence: Synthetic light chain variable region
DIQVTQSPSSLSASVGDRVTITCRASQPIASYLNWYQQKPGQAPKLLIYAASMLQSGAPSKFSGRGSGTDFTLTITTLQPEDFATYYCQQSYTFPYTFGQGTKVEIK

SEQ ID NO: 619 - protein, 11 aa, Artificial Sequence
  Description of Artificial Sequence: Synthetic light chain variable region CDR L1
RASQPIASYLN

SEQ ID NO: 620 - DNA, 33 bp, Artificial Sequence
  Description of Artificial Sequence: Synthetic light chain variable region CDR L1
cgggcaagtcagcccattgccagttatttaaat

SEQ ID NO: 621 - protein, 7 aa, Artificial Sequence
  Description of Artificial Sequence: Synthetic light chain variable region CDR L2
AASMLQS

SEQ ID NO: 622 - DNA, 21 bp, Artificial Sequence
  Description of Artificial Sequence: Synthetic light chain variable region CDR L2
gctgcatccatgttgcagagt

SEQ ID NO: 623 - protein, 9 aa, Artificial Sequence
  Description of Artificial Sequence: Synthetic light chain variable region CDR L3
QQSYTFPYT

SEQ ID NO: 624 - DNA, 27 bp, Artificial Sequence
  Description of Artificial Sequence: Synthetic light chain variable region CDR L3
caacagagttacactttcccgtacact

SEQ ID NO: 625 - DNA, 369 bp, Artificial Sequence
  Description of Artificial Sequence: Synthetic heavy chain variable region
gaggtgcagctggtggagtctgggggaggcttggtcaagcctggagggtccctgagactctcctgtgcagcctctggattcaccttcagtgactactacatgagctggatccgccaggctccagggaagggactggagtgggtttcatatattagtattagtagtagttacacagactacgcagactctgtgaagggccgattcaccatctccagagacaacgccaagaactcactgtatctgcaaatgaacagcctgagagccgaggacacggccgtgtattactgtgcgagagatcaacgagaccaagcagtggctggtcggtggttcgacccctggggccagggaaccctggtcaccgtctcctca

SEQ ID NO: 626 - protein, 123 aa, Artificial Sequence
  Description of Artificial Sequence: Synthetic heavy chain variable region
EVQLVESGGGLVKPGGSLRLSCAASGFTFSDYYMSWIRQAPGKGLEWVSYISISSSYTDYADSVKGRFTISRDNAKNSLYLQMNSLRAEDTAVYYCARDQRDQAVAGRWFDPWGQGTLVTVSS

SEQ ID NO: 627 - protein, 9 aa, Artificial Sequence
  Description of Artificial Sequence: Synthetic heavy chain variable region CDR H1
FTFSDYYMS

SEQ ID NO: 628 - DNA, 27 bp, Artificial Sequence
  Description of Artificial Sequence: Synthetic heavy chain variable region CDR H1
ttcaccttcagtgactactacatgagc

SEQ ID NO: 629 - protein, 17 aa, Artificial Sequence
  Description of Artificial Sequence: Synthetic heavy chain variable region CDR H2
YISISSSYTDYADSVKG

SEQ ID NO: 630 - DNA, 51 bp, Artificial Sequence
  Description of Artificial Sequence: Synthetic heavy chain variable region CDR H2
tatattagtattagtagtagttacacagactacgcagactctgtgaagggc

SEQ ID NO: 631 - protein, 16 aa, Artificial Sequence
  Description of Artificial Sequence: Synthetic heavy chain variable region CDR H3
ARDQRDQAVAGRWFDP

SEQ ID NO: 632 - DNA, 48 bp, Artificial Sequence
  Description of Artificial Sequence: Synthetic heavy chain variable region CDR H3
gcgagagatcaacgagaccaagcagtggctggtcggtggttcgacccc

SEQ ID NO: 633 - DNA, 336 bp, Artificial Sequence
  Description of Artificial Sequence: Synthetic light chain variable region
cagtctgtggtgacgcagccgccctcagtgtctggggccccagggcagagggtcaccatctcctgcactgggagcagctccaacatcggggcaggttttgatgtacactggtaccagcaggttccaggaacagcccccaaactcctcatctatgctaacaccaatcggccctcaggggtcccagaccgattctctggctccaagtctggcacctcagcctccctggccatcactgggctcaaggctgaggatgaggctgattattactgccagtcctatgacaacagcctgagtggttcggcggtcttcggcggagggaccaaggtcaccgtccta

SEQ ID NO: 634 - protein, 112 aa, Artificial Sequence
  Description of Artificial Sequence: Synthetic light chain variable region
QSVVTQPPSVSGAPGQRVTISCTGSSSNIGAGFDVHWYQQVPGTAPKLLIYANTNRPSGVPDRFSGSKSGTSASLAITGLKAEDEADYYCQSYDNSLSGSAVFGGGTKVTVL

SEQ ID NO: 635 - protein, 14 aa, Artificial Sequence
  Description of Artificial Sequence: Synthetic light chain variable region CDR L1
TGSSSNIGAGFDVH

SEQ ID NO: 636 - DNA, 42 bp, Artificial Sequence
  Description of Artificial Sequence: Synthetic light chain variable region CDR L1
actgggagcagctccaacatcggggcaggttttgatgtacac

SEQ ID NO: 637 - protein, 7 aa, Artificial Sequence
  Description of Artificial Sequence: Synthetic light chain variable region CDR L2
ANTNRPS

SEQ ID NO: 638 - DNA, 21 bp, Artificial Sequence
  Description of Artificial Sequence: Synthetic light chain variable region CDR L2
gctaacaccaatcggccctca

SEQ ID NO: 639 - protein, 12 aa, Artificial Sequence
  Description of Artificial Sequence: Synthetic light chain variable region CDR L3
QSYDNSLSGSAV

SEQ ID NO: 640 - DNA, 36 bp, Artificial Sequence
  Description of Artificial Sequence: Synthetic light chain variable region CDR L3
cagtcctatgacaacagcctgagtggttcggcggtc

SEQ ID NO: 641 - DNA, 366 bp, Artificial Sequence
  Description of Artificial Sequence: Synthetic heavy chain variable region
caggtgcagctggtgcaatctggttctgaggtgaagcagcctggggcctcagtgaaggtctcctgcaaggcctctggatacaccttcagcgcctaccatctgcactgggtgcgccaggcccccggacaagggcttcagtggctgggcaggatcaaccctaacagtggtgccacaagcgttgcacataactttcagggcagggtcaccttgaccacggacacgtccatcagcacagcctacatggagctgagcagcctgacgtctgacgacagtgccgtgtattactgcgcgagaactatgtggcggtggctggtcgaggggggctttgagaactggggccagggaaccctggtcaccgtctcctca

SEQ ID NO: 642 - protein, 122 aa, Artificial Sequence
  Description of Artificial Sequence: Synthetic heavy chain variable region
QVQLVQSGSEVKQPGASVKVSCKASGYTFSAYHLHWVRQAPGQGLQWLGRINPNSGATSVAHNFQGRVTLTTDTSISTAYMELSSLTSDDSAVYYCARTMWRWLVEGGFENWGQGTLVTVSS

SEQ ID NO: 643 - protein, 9 aa, Artificial Sequence
  Description of Artificial Sequence: Synthetic heavy chain variable region CDR H1
YTFSAYHLH

SEQ ID NO: 644 - DNA, 27 bp, Artificial Sequence
  Description of Artificial Sequence: Synthetic heavy chain variable region CDR H1
tacaccttcagcgcctaccatctgcac

SEQ ID NO: 645 - protein, 17 aa, Artificial Sequence
  Description of Artificial Sequence: Synthetic heavy chain variable region CDR H2
RINPNSGATSVAHNFQG

SEQ ID NO: 646 - DNA, 51 bp, Artificial Sequence
  Description of Artificial Sequence: Synthetic heavy chain variable region CDR H2
aggatcaaccctaacagtggtgccacaagcgttgcacataactttcagggc

SEQ ID NO: 647 - protein, 15 aa, Artificial Sequence
  Description of Artificial Sequence: Synthetic heavy chain variable region CDR H3
ARTMWRWLVEGGFEN

SEQ ID NO: 648 - DNA, 45 bp, Artificial Sequence
  Description of Artificial Sequence: Synthetic heavy chain variable region CDR H3
gcgagaactatgtggcggtggctggtcgaggggggctttgagaac

SEQ ID NO: 649 - DNA, 336 bp, Artificial Sequence
  Description of Artificial Sequence: Synthetic light chain variable region
gacatccggatgacccagtctccactctccctgcccgtcacccctggagagccggcctccatctcctgcaggtctagtcagagcctcctgcatagtaatggagacaactatttggattggtacctgcagaagccagggcagtctccacaggtcctgatctatctgggttctaatcgggcctccggggtccctgacaggttcagtggcagtggatcaggcacagattttacactgaaaatcagcagagtggaggctgaggatgttggggtttattactgcatgcaagctctacaaactccgctcactttcggcggagggaccaaggtggaaatcaaa

SEQ ID NO: 650 - protein, 112 aa, Artificial Sequence
  Description of Artificial Sequence: Synthetic light chain variable region
DIRMTQSPLSLPVTPGEPASISCRSSQSLLHSNGDNYLDWYLQKPGQSPQVLIYLGSNRASGVPDRFSGSGSGTDFTLKISRVEAEDVGVYYCMQALQTPLTFGGGTKVEIK

SEQ ID NO: 651 - protein, 16 aa, Artificial Sequence
  Description of Artificial Sequence: Synthetic light chain variable region CDR L1
RSSQSLLHSNGDNYLD

SEQ ID NO: 652 - DNA, 48 bp, Artificial Sequence
  Description of Artificial Sequence: Synthetic light chain variable region CDR L1
aggtctagtcagagcctcctgcatagtaatggagacaactatttggat

SEQ ID NO: 653 - protein, 7 aa, Artificial Sequence
  Description of Artificial Sequence: Synthetic light chain variable region CDR L2
LGSNRAS

SEQ ID NO: 654 - DNA, 21 bp, Artificial Sequence
  Description of Artificial Sequence: Synthetic light chain variable region CDR L2
ctgggttctaatcgggcctcc

SEQ ID NO: 655 - protein, 9 aa, Artificial Sequence
  Description of Artificial Sequence: Synthetic light chain variable region CDR L3
MQALQTPLT

SEQ ID NO: 656 - DNA, 27 bp, Artificial Sequence
  Description of Artificial Sequence: Synthetic light chain variable region CDR L3
atgcaagctctacaaactccgctcact

SEQ ID NO: 657 - DNA, 363 bp, Artificial Sequence
  Description of Artificial Sequence: Synthetic heavy chain variable region
caggtccagctggtgcagtctggggctgaggtgaagaagccggggtcctcgatgagcatctcctgtcgggcttctggaggctccttcaacaaccaagctatacactggatccgccaggcccctggagaaggacttgagtggatgggaaatatcatccctaatttcggatctcaaaactacgcgccggaattcgtgggcagggtcagcttcaatgcggacgcttccgctggcactgcctacatggacttgagtgatctgacatctcaagacacggccgtctattactgtgcgacagccgggtggttcggggaattggtgcgctttgactcctggggccagggaaccctggtcaccgtctcctca

SEQ ID NO: 658 - protein, 121 aa, Artificial Sequence
  Description of Artificial Sequence: Synthetic heavy chain variable region
QVQLVQSGAEVKKPGSSMSISCRASGGSFNNQAIHWIRQAPGEGLEWMGNIIPNFGSQNYAPEFVGRVSFNADASAGTAYMDLSDLTSQDTAVYYCATAGWFGELVRFDSWGQGTLVTVSS

SEQ ID NO: 659 - protein, 9 aa, Artificial Sequence
  Description of Artificial Sequence: Synthetic heavy chain variable region CDR H1
GSFNNQAIH

SEQ ID NO: 660 - DNA, 27 bp, Artificial Sequence
  Description of Artificial Sequence: Synthetic heavy chain variable region CDR H1
ggctccttcaacaaccaagctatacac

SEQ ID NO: 661 - protein, 17 aa, Artificial Sequence
  Description of Artificial Sequence: Synthetic heavy chain variable region CDR H2
NIIPNFGSQNYAPEFVG

SEQ ID NO: 662 - DNA, 51 bp, Artificial Sequence
  Description of Artificial Sequence: Synthetic heavy chain variable region CDR H2
aatatcatccctaatttcggatctcaaaactacgcgccggaattcgtgggc

SEQ ID NO: 663 - protein, 14 aa, Artificial Sequence
  Description of Artificial Sequence: Synthetic heavy chain variable region CDR H3
ATAGWFGELVRFDS

SEQ ID NO: 664 - DNA, 42 bp, Artificial Sequence
  Description of Artificial Sequence: Synthetic heavy chain variable region CDR H3
gcgacagccgggtggttcggggaattggtgcgctttgactcc

SEQ ID NO: 665 - DNA, 324 bp, Artificial Sequence
  Description of Artificial Sequence: Synthetic light chain variable region
gatattgtgatgacgcagtctccagccaccctgtctgtgtctccagggggaagggccaccctctcctgcagggccagtgagactattaccactaacttagcctggtaccagcagaagcctggccaggctcccaggctcctcatctatggtgcgtccaccagggccactggtatcccagccaggttcagtggcagtgggtcagggacagagttcactctcaccatcaacagcctgcagtctgaggattttgcagtttattactgtcagcagtataataactggcctcctctcactttcggcggagggaccaagctggagatcaaa

SEQ ID NO: 666 - protein, 108 aa, Artificial Sequence
  Description of Artificial Sequence: Synthetic light chain variable region
DIVMTQSPATLSVSPGGRATLSCRASETITTNLAWYQQKPGQAPRLLIYGASTRATGIPARFSGSGSGTEFTLTINSLQSEDFAVYYCQQYNNWPPLTFGGGTKLEIK

SEQ ID NO: 667 - protein, 11 aa, Artificial Sequence
  Description of Artificial Sequence: Synthetic light chain variable region CDR L1
RASETITTNLA

SEQ ID NO: 668 - DNA, 33 bp, Artificial Sequence
  Description of Artificial Sequence: Synthetic light chain variable region CDR L1
agggccagtgagactattaccactaacttagcc

SEQ ID NO: 669 - protein, 7 aa, Artificial Sequence
  Description of Artificial Sequence: Synthetic light chain variable region CDR L2
GASTRAT

SEQ ID NO: 670 - DNA, 21 bp, Artificial Sequence
  Description of Artificial Sequence: Synthetic light chain variable region CDR L2
ggtgcgtccaccagggccact

SEQ ID NO: 671 - protein, 10 aa, Artificial Sequence
  Description of Artificial Sequence: Synthetic light chain variable region CDR L3
QQYNNWPPLT

SEQ ID NO: 672 - DNA, 30 bp, Artificial Sequence; identical to SEQ ID NO: 64
  Description of Artificial Sequence: Synthetic light chain variable region CDR L3

SEQ ID NO: 673 - DNA, 366 bp, Artificial Sequence
  Description of Artificial Sequence: Synthetic heavy chain variable region
caggtgcagctacagcagtggggcgcaggactggtgaagccttcggagaccctgtccctcacctgcgctgtgtctggtgggtccttcaggggttaccagtggaactggttccgccagccccccgggaagggtctggagtggattggggaaatcaatcatggtgaatacacccactacaacgcgtccctcaagagtcgcgtcagtttatctatagacacgtccaagaaccagttctcccttaatctgacctctgtgaccgccgcggacacggctatgtatttttgtgcgagagcctcgagtgggacctataacttcgagtactggttcgacccctggggccagggaaccctggtcaccgtctcctca

SEQ ID NO: 674 - protein, 122 aa, Artificial Sequence
  Description of Artificial Sequence: Synthetic heavy chain variable region
QVQLQQWGAGLVKPSETLSLTCAVSGGSFRGYQWNWFRQPPGKGLEWIGEINHGEYTHYNASLKSRVSLSIDTSKNQFSLNLTSVTAADTAMYFCARASSGTYNFEYWFDPWGQGTLVTVSS

SEQ ID NO: 675 - protein, 9 aa, Artificial Sequence
  Description of Artificial Sequence: Synthetic heavy chain variable region CDR H1
GSFRGYQWN

SEQ ID NO: 676 - DNA, 27 bp, Artificial Sequence
  Description of Artificial Sequence: Synthetic heavy chain variable region CDR H1
gggtccttcaggggttaccagtggaac

SEQ ID NO: 677 - protein, 16 aa, Artificial Sequence
  Description of Artificial Sequence: Synthetic heavy chain variable region CDR H2
EINHGEYTHYNASLKS

SEQ ID NO: 678 - DNA, 48 bp, Artificial Sequence
  Description of Artificial Sequence: Synthetic heavy chain variable region CDR H2
gaaatcaatcatggtgaatacacccactacaacgcgtccctcaagagt

SEQ ID NO: 679 - protein, 16 aa, Artificial Sequence
  Description of Artificial Sequence: Synthetic heavy chain variable region CDR H3
ARASSGTYNFEYWFDP

SEQ ID NO: 680 - DNA, 48 bp, Artificial Sequence
  Description of Artificial Sequence: Synthetic heavy chain variable region CDR H3
gcgagagcctcgagtgggacctataacttcgagtactggttcgacccc

SEQ ID NO: 681 - DNA, 324 bp, Artificial Sequence
  Description of Artificial Sequence: Synthetic light chain variable region
tcctatgtgctgacacagccaccctcggtgtcagtggccccaggaaagacggcctggcttacctgtgggggaaacaacattggaaataaaagagtgcactggtaccagcagaagccaggccaggcccctgtgctggtcgtgtatgatgattacggccggccctcagggacctctgagcgagtctctggctccaactctgggaacacggccaccctgaccatcagcagggtcgaagccggggatgaggccgagtattattgtcaggtgtgggatgatcccagtgatcatgcggtgttcggcggaggcacccagctgaccgtcctc

SEQ ID NO: 682 - protein, 108 aa, Artificial Sequence
  Description of Artificial Sequence: Synthetic light chain variable region
SYVLTQPPSVSVAPGKTAWLTCGGNNIGNKRVHWYQQKPGQAPVLVVYDDYGRPSGTSERVSGSNSGNTATLTISRVEAGDEAEYYCQVWDDPSDHAVFGGGTQLTVL

SEQ ID NO: 683 - protein, 11 aa, Artificial Sequence
  Description of Artificial Sequence: Synthetic light chain variable region CDR L1
GGNNIGNKRVH

SEQ ID NO: 684 - DNA, 33 bp, Artificial Sequence
  Description of Artificial Sequence: Synthetic light chain variable region CDR L1
gggggaaacaacattggaaataaaagagtgcac

SEQ ID NO: 685 - protein, 7 aa, Artificial Sequence
  Description of Artificial Sequence: Synthetic light chain variable region CDR L2
DDYGRPS

SEQ ID NO: 686 - DNA, 21 bp, Artificial Sequence
  Description of Artificial Sequence: Synthetic light chain variable region CDR L2
gatgattacggccggccctca

SEQ ID NO: 687 - protein, 11 aa, Artificial Sequence
  Description of Artificial Sequence: Synthetic light chain variable region CDR L3
QVWDDPSDHAV

SEQ ID NO: 688 - DNA, 33 bp, Artificial Sequence
  Description of Artificial Sequence: Synthetic light chain variable region CDR L3
caggtgtgggatgatcccagtgatcatgcggtg

SEQ ID NO: 689 - DNA, 363 bp, Artificial Sequence
  Description of Artificial Sequence: Synthetic heavy chain variable region
caggtccagctggtgcagtctgggggacgactggtcaagcctggggggtccctgagactctcctgtggaatgtctggattcggcttcagtagttatagaatgaattgggtccgccaggctccagggaagggactggagtggatctcatcgattagtgctagtagtagttatacagactacgcgaattcagtgaagggccgattcaccatctccagagacggcgccaatttgtttctgcaaatgaacagcctgagagtcgaggacacggctgtgtattattgtgcgagagattgggggggacattccatttttggagcggtccaagacctctggggccagggaaccctggtcaccgtctcctca

SEQ ID NO: 690 - protein, 121 aa, Artificial Sequence
  Description of Artificial Sequence: Synthetic heavy chain variable region
QVQLVQSGGRLVKPGGSLRLSCGMSGFGFSSYRMNWVRQAPGKGLEWISSISASSSYTDYANSVKGRFTISRDGANLFLQMNSLRVEDTAVYYCARDWGGHSIFGAVQDLWGQGTLVTVSS

SEQ ID NO: 691 - protein, 9 aa, Artificial Sequence
  Description of Artificial Sequence: Synthetic heavy chain variable region CDR H1
FGFSSYRMN

SEQ ID NO: 692 - DNA, 27 bp, Artificial Sequence
  Description of Artificial Sequence: Synthetic heavy chain variable region CDR H1
ttcggcttcagtagttatagaatgaat

SEQ ID NO: 693 - protein, 17 aa, Artificial Sequence
  Description of Artificial Sequence: Synthetic heavy chain variable region CDR H2
SISASSSYTDYANSVKG

SEQ ID NO: 694 - DNA, 51 bp, Artificial Sequence
  Description of Artificial Sequence: Synthetic heavy chain variable region CDR H2
tcgattagtgctagtagtagttatacagactacgcgaattcagtgaagggc

SEQ ID NO: 695 - protein, 16 aa, Artificial Sequence
  Description of Artificial Sequence: Synthetic heavy chain variable region CDR H3
ARDWGGHSIFGAVQDL

SEQ ID NO: 696 - DNA, 48 bp, Artificial Sequence
  Description of Artificial Sequence: Synthetic heavy chain variable region CDR H3
gcgagagattgggggggacattccatttttggagcggtccaagacctc

SEQ ID NO: 697 - DNA, 330 bp, Artificial Sequence
  Description of Artificial Sequence: Synthetic light chain variable region
cagtctgtgctgacgcagccgccctcagtgtctggggcccctgggcagagggtcaccatctcctgctctgggagcagttccaacatcggggcaggttatgatgtccactggtaccagcagcttccaggaacagcccccaaactcctcatctatggtaacaccaatcggccctcaggggtccctgaccgattctctggctccaagtctggcacgtcagcctccctggccatcactggcctccaggccgaggatgaggctgattattactgccagtcctatgacagaagcctgagtcaggtcttcggagctgggaccaaggtgaccgtccta

SEQ ID NO: 698 - protein, 110 aa, Artificial Sequence
  Description of Artificial Sequence: Synthetic light chain variable region
QSVLTQPPSVSGAPGQRVTISCSGSSSNIGAGYDVHWYQQLPGTAPKLLIYGNTNRPSGVPDRFSGSKSGTSASLAITGLQAEDEADYYCQSYDRSLSQVFGAGTKVTVL

SEQ ID NO: 699 - protein, 14 aa, Artificial Sequence
  Description of Artificial Sequence: Synthetic light chain variable region CDR L1
SGSSSNIGAGYDVH

SEQ ID NO: 700 - DNA, 42 bp, Artificial Sequence
  Description of Artificial Sequence: Synthetic light chain variable region CDR L1
tctgggagcagttccaacatcggggcaggttatgatgtccac

SEQ ID NO: 701 - protein, 7 aa, Artificial Sequence
  Description of Artificial Sequence: Synthetic light chain variable region CDR L2
GNTNRPS

SEQ ID NO: 702 - DNA, 21 bp, Artificial Sequence
  Description of Artificial Sequence: Synthetic light chain variable region CDR L2
ggtaacaccaatcggccctca

SEQ ID NO: 703 - protein, 10 aa, Artificial Sequence
  Description of Artificial Sequence: Synthetic light chain variable region CDR L3
QSYDRSLSQV

SEQ ID NO: 704 - DNA, 30 bp, Artificial Sequence
  Description of Artificial Sequence: Synthetic light chain variable region CDR L3
cagtcctatgacagaagcctgagtcaggtc

SEQ ID NO: 705 - DNA, 378 bp, Artificial Sequence; identical to SEQ ID NO: 305
  Description of Artificial Sequence: Synthetic heavy chain variable region

SEQ ID NO: 706 - protein, 126 aa, Artificial Sequence; identical to SEQ ID NO: 306
  Description of Artificial Sequence: Synthetic heavy chain variable region

SEQ ID NO: 707 - protein, 11 aa, Artificial Sequence
  Description of Artificial Sequence: Synthetic heavy chain variable region CDR H1
FSLDTQRTGVN

SEQ ID NO: 708 - DNA, 33 bp, Artificial Sequence; identical to SEQ ID NO: 308
  Description of Artificial Sequence: Synthetic heavy chain variable region CDR H1

SEQ ID NO: 709 - protein, 16 aa, Artificial Sequence
  Description of Artificial Sequence: Synthetic heavy chain variable region CDR H2
RIDWDGNIYSSTSVRT

SEQ ID NO: 710 - DNA, 48 bp, Artificial Sequence; identical to SEQ ID NO: 310
  Description of Artificial Sequence: Synthetic heavy chain variable region CDR H2

SEQ ID NO: 711 - protein, 18 aa, Artificial Sequence
  Description of Artificial Sequence: Synthetic heavy chain variable region CDR H3
ARTLYYTSGGYYLNLFDY

SEQ ID NO: 712 - DNA, 54 bp, Artificial Sequence; identical to SEQ ID NO: 312
  Description of Artificial Sequence: Synthetic heavy chain variable region CDR H3

SEQ ID NO: 713 - DNA, 321 bp, Artificial Sequence
  Description of Artificial Sequence: Synthetic light chain variable region
gaaattgtgatgacgcagtctccaccctccctgtctgcctctgttggggacagagtcaccatcacttgccgggcaagtcagacaattcccagctatgtcaattggtatcagcagatatcagggaaagcccctcgcctcctgatctatgctgcctcacttttgcaaagtggggtcccatcaaggttcagtggcagcggatctgggacagagttcagtctcaccatcagcggtctgcgacctgaggattttggcacttactactgtcaacagagttacagttccactcccactttcggccaggggacacgactggagattaaa

SEQ ID NO: 714 - protein, 107 aa, Artificial Sequence
  Description of Artificial Sequence: Synthetic light chain variable region
EIVMTQSPPSLSASVGDRVTITCRASQTIPSYVNWYQQISGKAPRLLIYAASLLQSGVPSRFSGSGSGTEFSLTISGLRPEDFGTYYCQQSYSSTPTFGQGTRLEIK

SEQ ID NO: 715 - protein, 11 aa, Artificial Sequence
  Description of Artificial Sequence: Synthetic light chain variable region CDR L1
RASQTIPSYVN

SEQ ID NO: 716 - DNA, 33 bp, Artificial Sequence; identical to SEQ ID NO: 316
  Description of Artificial Sequence: Synthetic light chain variable region CDR L1

SEQ ID NO: 717 - protein, 7 aa, Artificial Sequence
  Description of Artificial Sequence: Synthetic light chain variable region CDR L2
AASLLQS

SEQ ID NO: 718 - DNA, 21 bp, Artificial Sequence
  Description of Artificial Sequence: Synthetic light chain variable region CDR L2
gctgcctcacttttgcaaagt

SEQ ID NO: 719 - protein, 9 aa, Artificial Sequence
  Description of Artificial Sequence: Synthetic light chain variable region CDR L3
QQSYSSTPT

SEQ ID NO: 720 - DNA, 27 bp, Artificial Sequence
  Description of Artificial Sequence: Synthetic light chain variable region CDR L3
caacagagttacagttccactcccact

SEQ ID NO: 721 - DNA, 378 bp, Artificial Sequence
  Description of Artificial Sequence: Synthetic heavy chain variable region
gaggtgcagctggtggagtctggggctgaggtgaagaggcctgggtcctcggtgaaggtctcctgtaaggttgtcggaggcagtttcagcaactatgctatcagctgggtgcgacaggcccctggacaagggcctgagtatctgggagggatcatccccgcctttaggacagcaaaatatgcaaagaaattccaggacagactcacaattaccgcggacgaatctacgagcactgcctacatggaaatgaggggcctgacatctgacgacacgggcctatattattgtgcgaggcctgaaggagactttggggatttgaagtggctacgatcgccctttgactactggggccagggaaccctggtcaccgtctcctca

SEQ ID NO: 722 - protein, 126 aa, Artificial Sequence
  Description of Artificial Sequence: Synthetic heavy chain variable region
EVQLVESGAEVKRPGSSVKVSCKVVGGSFSNYAISWVRQAPGQGPEYLGGIIPAFRTAKYAKKFQDRLTITADESTSTAYMEMRGLTSDDTGLYYCARPEGDFGDLKWLRSPFDYWGQGTLVTVSS

SEQ ID NO: 723 - protein, 9 aa, Artificial Sequence
  Description of Artificial Sequence: Synthetic heavy chain variable region CDR H1
GSFSNYAIS

SEQ ID NO: 724 - DNA, 27 bp, Artificial Sequence
  Description of Artificial Sequence: Synthetic heavy chain variable region CDR H1
ggcagtttcagcaactatgctatcagc

SEQ ID NO: 725 - protein, 17 aa, Artificial Sequence
  Description of Artificial Sequence: Synthetic heavy chain variable region CDR H2
GIIPAFRTAKYAKKFQD

SEQ ID NO: 726 - DNA, 51 bp, Artificial Sequence
  Description of Artificial Sequence: Synthetic heavy chain variable region CDR H2
gggatcatccccgcctttaggacagcaaaatatgcaaagaaattccaggac

SEQ ID NO: 727 - protein, 19 aa, Artificial Sequence
  Description of Artificial Sequence: Synthetic heavy chain variable region CDR H3
ARPEGDFGDLKWLRSPFDY

SEQ ID NO: 728 - DNA, 57 bp, Artificial Sequence
  Description of Artificial Sequence: Synthetic heavy chain variable region CDR H3
gcgaggcctgaaggagactttggggatttgaagtggctacgatcgccctttgactac

SEQ ID NO: 729 - DNA, 327 bp, Artificial Sequence
  Description of Artificial Sequence: Synthetic light chain variable region
gaaattgtgttgacgcagtctccagccaccctgtctgtgtctccagggcaaagagtcaccctttcctgcagggccagtcagggtgtgagcatcaacttagcctggtaccagcagaaacctggccagcctcccaggctcctcatctatggtgcatccacccgggccactgatatcccagccaggttcagtggcagtgggtctgggacagacttcactctcaccatcagcagcctgcagtctgaagattttgcagtttattattgtcagcagtatgatgactggcctccccagctcactttcggccctgggaccaagctggagatcaaa

SEQ ID NO: 730 - protein, 109 aa, Artificial Sequence
  Description of Artificial Sequence: Synthetic light chain variable region
EIVLTQSPATLSVSPGQRVTLSCRASQGVSINLAWYQQKPGQPPRLLIYGASTRATDIPARFSGSGSGTDFTLTISSLQSEDFAVYYCQQYDDWPPQLTFGPGTKLEIK

SEQ ID NO: 731 - protein, 11 aa, Artificial Sequence
  Description of Artificial Sequence: Synthetic light chain variable region CDR L1
RASQGVSINLA

SEQ ID NO: 732 - DNA, 33 bp, Artificial Sequence
  Description of Artificial Sequence: Synthetic light chain variable region CDR L1
agggccagtcagggtgtgagcatcaacttagcc

SEQ ID NO: 733 - protein, 7 aa, Artificial Sequence
  Description of Artificial Sequence: Synthetic light chain variable region CDR L2
GASTRAT

SEQ ID NO: 734 - DNA, 21 bp, Artificial Sequence
  Description of Artificial Sequence: Synthetic light chain variable region CDR L2
ggtgcatccacccgggccact

SEQ ID NO: 735 - protein, 11 aa, Artificial Sequence
  Description of Artificial Sequence: Synthetic light chain variable region CDR L3
QQYDDWPPQLT

SEQ ID NO: 736 - DNA, 33 bp, Artificial Sequence
  Description of Artificial Sequence: Synthetic light chain variable region CDR L3
cagcagtatgatgactggcctccccagctcact

SEQ ID NO: 737 - DNA, 384 bp, Artificial Sequence
  Description of Artificial Sequence: Synthetic heavy chain variable region
caggtgcagctgcaggagtcgggcccaggactagtgaagccttcggagaccctgtccctcacctgcactgtctctggtggctccatcaataactacttctggagctggatccggcagcccccagggaagggactggagtggcttggatatatctacaacagtgggagcacctactacaacccctccctcaacagtcgagtcaccatctcattacaaaagtccaagaaccagttctccctgcacctgacgtccatgaccgccgccgatacggccgtgtatttctgtgcgagacatccaagtgtgatctacgggactttcggcgccaacggggggccaaactggttcgacccctggggccagggaaccctggtcaccgtctcctca

SEQ ID NO: 738 - protein, 128 aa, Artificial Sequence
  Description of Artificial Sequence: Synthetic heavy chain variable region
QVQLQESGPGLVKPSETLSLTCTVSGGSINNYFWSWIRQPPGKGLEWLGYIYNSGSTYYNPSLNSRVTISLQKSKNQFSLHLTSMTAADTAVYFCARHPSVIYGTFGANGGPNWFDPWGQGTLVTVSS

SEQ ID NO: 739 - protein, 9 aa, Artificial Sequence
  Description of Artificial Sequence: Synthetic heavy chain variable region CDR H1
GSINNYFWS

SEQ ID NO: 740 - DNA, 27 bp, Artificial Sequence
  Description of Artificial Sequence: Synthetic heavy chain variable region CDR H1
ggctccatcaataactacttctggagc

SEQ ID NO: 741 - protein, 16 aa, Artificial Sequence
  Description of Artificial Sequence: Synthetic heavy chain variable region CDR H2
YIYNSGSTYYNPSLNS

SEQ ID NO: 742 - DNA, 48 bp, Artificial Sequence
  Description of Artificial Sequence: Synthetic heavy chain variable region CDR H2
tatatctacaacagtgggagcacctactacaacccctccctcaacagt

SEQ ID NO: 743 - protein, 22 aa, Artificial Sequence
  Description of Artificial Sequence: Synthetic heavy chain variable region CDR H3
ARHPSVIYGTFGANGGPNWFDP

SEQ ID NO: 744 - DNA, 66 bp, Artificial Sequence
  Description of Artificial Sequence: Synthetic heavy chain variable region CDR H3
gcgagacatccaagtgtgatctacgggactttcggcgccaacggggggccaaactggttcgacccc

SEQ ID NO: 745 - DNA, 330 bp, Artificial Sequence
  Description of Artificial Sequence: Synthetic light chain variable region
cagtctgttctgactcagcctgcctccgtgtctgggtctcctggacagtcgatcaccatctcctgcactggaaccagcagtgacgttggtggttataactatgtctcctggtaccaacaacacccaggcaaggcccccaaactcatgattttcgatgtcacttatcggccctcagggatttctaatcgcttctctggctccaagtctggcaacacggcctccctgaccatctctgggctccactctgaggacgaggctgattattattgcagctcatatacaggcagcaacaccgtgattttcggcggagggaccaagctgaccgtccta

SEQ ID NO: 746 - protein, 110 aa, Artificial Sequence
  Description of Artificial Sequence: Synthetic light chain variable region
QSVLTQPASVSGSPGQSITISCTGTSSDVGGYNYVSWYQQHPGKAPKLMIFDVTYRPSGISNRFSGSKSGNTASLTISGLHSEDEADYYCSSYTGSNTVIFGGGTKLTVL

SEQ ID NO: 747 - protein, 14 aa, Artificial Sequence
  Description of Artificial Sequence: Synthetic light chain variable region CDR L1
TGTSSDVGGYNYVS

SEQ ID NO: 748 - DNA, 42 bp, Artificial Sequence; identical to SEQ ID NO: 380
  Description of Artificial Sequence: Synthetic light chain variable region CDR L1

SEQ ID NO: 749 - protein, 7 aa, Artificial Sequence
  Description of Artificial Sequence: Synthetic light chain variable region CDR L2
DVTYRPS

SEQ ID NO: 750 - DNA, 21 bp, Artificial Sequence
  Description of Artificial Sequence: Synthetic light chain variable region CDR L2
gatgtcacttatcggccctca

SEQ ID NO: 751 - protein, 10 aa, Artificial Sequence
  Description of Artificial Sequence: Synthetic light chain variable region CDR L3
SSYTGSNTVI

SEQ ID NO: 752 - DNA, 30 bp, Artificial Sequence
  Description of Artificial Sequence: Synthetic light chain variable region CDR L3
agctcatatacaggcagcaacaccgtgatt

SEQ ID NO: 753 - DNA, 366 bp, Artificial Sequence
  Description of Artificial Sequence: Synthetic heavy chain variable region
caggtccagcttgtacagtctggggctgaagtgaagaagcctggggcctcagtgagggtctcctgcaaggcttctggctacaccttcagcagctactatattcactgggtgcgacaggcccctggacaagggcctgagtggctgggatggatcaacccaaagagtggtgacacaatctattcatataagtttcagggcagggtcaccttgaccagggaaacgtcaatcaccacagcctacatggagttgaccagtctgagatctgacgacacggccgtctattactgtgcgcgagttacttggcagtggctggtcctggggggttttgactactggggccagggaaccctggtcaccgtctcctca

SEQ ID NO: 754 - protein, 122 aa, Artificial Sequence
  Description of Artificial Sequence: Synthetic heavy chain variable region
QVQLVQSGAEVKKPGASVRVSCKASGYTFSSYYIHWVRQAPGQGPEWLGWINPKSGDTIYSYKFQGRVTLTRETSITTAYMELTSLRSDDTAVYYCARVTWQWLVLGGFDYWGQGTLVTVSS

SEQ ID NO: 755 - protein, 9 aa, Artificial Sequence
  Description of Artificial Sequence: Synthetic heavy chain variable region CDR H1
YTFSSYYIH

SEQ ID NO: 756 - DNA, 27 bp, Artificial Sequence
  Description of Artificial Sequence: Synthetic heavy chain variable region CDR H1
tacaccttcagcagctactatattcac

SEQ ID NO: 757 - protein, 17 aa, Artificial Sequence
  Description of Artificial Sequence: Synthetic heavy chain variable region CDR H2
WINPKSGDTIYSYKFQG

SEQ ID NO: 758 - DNA, 51 bp, Artificial Sequence
  Description of Artificial Sequence: Synthetic heavy chain variable region CDR H2
tggatcaacccaaagagtggtgacacaatctattcatataagtttcagggc

SEQ ID NO: 759 - protein, 15 aa, Artificial Sequence
  Description of Artificial Sequence: Synthetic heavy chain variable region CDR H3
ARVTWQWLVLGGFDY

SEQ ID NO: 760 - DNA, 45 bp, Artificial Sequence
  Description of Artificial Sequence: Synthetic heavy chain variable region CDR H3
gcgcgagttacttggcagtggctggtcctggggggttttgactac

SEQ ID NO: 761 - DNA, 336 bp, Artificial Sequence
  Description of Artificial Sequence: Synthetic light chain variable region
gatattgtgctgactcagtctccactctccctgcccgtcacccctggagagccggcctccatctcctgcaggtctagtctgagcctcctgcatagtaatggagacaactatttggattggtacctgcagaagccagggcagtctccacagctcctgatctatttgggttctaatcgggcctccggggtccctgacaggttcagtggcagtggatcaggcacagattttacactgaaaatcagccgagtggaggctgaggatgttggggtttattactgcatgcaagctctacacactcccctcactttcggcggagggaccaagctggagatcaaa

SEQ ID NO: 762 - protein, 112 aa, Artificial Sequence
  Description of Artificial Sequence: Synthetic light chain variable region
DIVLTQSPLSLPVTPGEPASISCRSSLSLLHSNGDNYLDWYLQKPGQSPQLLIYLGSNRASGVPDRFSGSGSGTDFTLKISRVEAEDVGVYYCMQALHTPLTFGGGTKLEIK

SEQ ID NO: 763 - protein, 16 aa, Artificial Sequence
  Description of Artificial Sequence: Synthetic light chain variable region CDR L1
RSSLSLLHSNGDNYLD

SEQ ID NO: 764 - DNA, 48 bp, Artificial Sequence
  Description of Artificial Sequence: Synthetic light chain variable region CDR L1
aggtctagtctgagcctcctgcatagtaatggagacaactatttggat

SEQ ID NO: 765 - protein, 7 aa, Artificial Sequence
  Description of Artificial Sequence: Synthetic light chain variable region CDR L2
LGSNRAS

SEQ ID NO: 766 - DNA, 21 bp, Artificial Sequence
  Description of Artificial Sequence: Synthetic light chain variable region CDR L2
ttgggttctaatcgggcctcc

SEQ ID NO: 767 - protein, 9 aa, Artificial Sequence
  Description of Artificial Sequence: Synthetic light chain variable region CDR L3
MQALHTPLT

SEQ ID NO: 768 - DNA, 27 bp, Artificial Sequence
  Description of Artificial Sequence: Synthetic light chain variable region CDR L3
atgcaagctctacacactcccctcact

SEQ ID NO: 769 - DNA, 375 bp, Artificial Sequence
  Description of Artificial Sequence: Synthetic heavy chain variable region
gaggtgcagctggtggagtctgggggaggcttggtccagcctggggggtccctgaaactctcctgtacttcctctgggctcgccttcagtggctctgctatacactgggtccgccaggcttccgggaaagggctggagtgggttggccgtattagaagcaaacctaacagttacgcgacagaatatgctgcgtcggtgaaggggaggttcaccatctccagagatgattcacagaacacggcgtatctgcaaatgaacagcctgaaagccgaggacacggccctgtattactgtactttaggatattgtagtggtgatagctgctcctctcttagggactactggggccagggaaccctggtcaccgtctcctca

SEQ ID NO: 770 - protein, 125 aa, Artificial Sequence
  Description of Artificial Sequence: Synthetic heavy chain variable region
EVQLVESGGGLVQPGGSLKLSCTSSGLAFSGSAIHWVRQASGKGLEWVGRIRSKPNSYATEYAASVKGRFTISRDDSQNTAYLQMNSLKAEDTALYYCTLGYCSGDSCSSLRDYWGQGTLVTVSS

SEQ ID NO: 771 - protein, 9 aa, Artificial Sequence
  Description of Artificial Sequence: Synthetic heavy chain variable region CDR H1
LAFSGSAIH

SEQ ID NO: 772 - DNA, 27 bp, Artificial Sequence
  Description of Artificial Sequence: Synthetic heavy chain variable region CDR H1
ctcgccttcagtggctctgctatacac

SEQ ID NO: 773 - protein, 19 aa, Artificial Sequence
  Description of Artificial Sequence: Synthetic heavy chain variable region CDR H2
RIRSKPNSYATEYAASVKG

SEQ ID NO: 774 - DNA, 57 bp, Artificial Sequence
  Description of Artificial Sequence: Synthetic heavy chain variable region CDR H2
cgtattagaagcaaacctaacagttacgcgacagaatatgctgcgtcggtgaagggg

SEQ ID NO: 775 - protein, 16 aa, Artificial Sequence
  Description of Artificial Sequence: Synthetic heavy chain variable region CDR H3
TLGYCSGDSCSSLRDY

SEQ ID NO: 776 - DNA, 48 bp, Artificial Sequence
  Description of Artificial Sequence: Synthetic heavy chain variable region CDR H3
actttaggatattgtagtggtgatagctgctcctctcttagggactac

SEQ ID NO: 777 - DNA, 330 bp, Artificial Sequence
  Description of Artificial Sequence: Synthetic light chain variable region
cagtctgctctgattcagcctgcctccgtgtctgggtctcctggacagtcgatcaccatctcctgcactggaaccagcagtgacgttggtggttataactatgtctcttggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagtagcagcactctcgtgttcggcggagggaccaaggtcaccgtccta

SEQ ID NO: 778 - protein, 110 aa, Artificial Sequence
  Description of Artificial Sequence: Synthetic light chain variable region
QSALIQPASVSGSPGQSITISCTGTSSDVGGYNYVSWYQQHPGKAPKLMIYDVSNRPSGVSNRFSGSKSGNTASLTISGLQAEDEADYYCSSYTSSSTLVFGGGTKVTVL

SEQ ID NO: 779 - protein, 14 aa, Artificial Sequence
  Description of Artificial Sequence: Synthetic light chain variable region CDR L1
TGTSSDVGGYNYVS

SEQ ID NO: 780 - DNA, 42 bp, Artificial Sequence
  Description of Artificial Sequence: Synthetic light chain variable region CDR L1
actggaaccagcagtgacgttggtggttataactatgtctct

SEQ ID NO: 781 - protein, 7 aa, Artificial Sequence
  Description of Artificial Sequence: Synthetic light chain variable region CDR L2
DVSNRPS

SEQ ID NO: 782 - DNA, 21 bp, Artificial Sequence
  Description of Artificial Sequence: Synthetic light chain variable region CDR L2
gatgtcagtaatcggccctca

SEQ ID NO: 783 - protein, 10 aa, Artificial Sequence
  Description of Artificial Sequence: Synthetic light chain variable region CDR L3
SSYTSSSTLV

SEQ ID NO: 784 - DNA, 30 bp, Artificial Sequence
  Description of Artificial Sequence: Synthetic light chain variable region CDR L3
agctcatatacaagtagcagcactctcgtg

SEQ ID NO: 785 - DNA, 363 bp, Artificial Sequence
  Description of Artificial Sequence: Synthetic heavy chain variable region
caggtccagctggtgcagtctggaagtgaggtgaagaagcctggggcctcggtgaaggtctcctgcaaggcctcaggttacaggttttccaactatggtatcagctgggtgcgacaggcccctggacaaggcctagagtggatgggatggatcagcgcttacaatggaaacataaagtatggaaataacctccagggcagagtcaccgtgaccacagacacatccacgaccacggcctacatggaggtgaggagcctgacatctgacgacacggccgtgtattactgtgcgagagatgtcccagctgacggggtccacttcatggacgtctggggcaaagggaccacggtcaccgtctcctca

SEQ ID NO: 786 - protein, 121 aa, Artificial Sequence
  Description of Artificial Sequence: Synthetic heavy chain variable region
QVQLVQSGSEVKKPGASVKVSCKASGYRFSNYGISWVRQAPGQGLEWMGWISAYNGNIKYGNNLQGRVTVTTDTSTTTAYMEVRSLTSDDTAVYYCARDVPADGVHFMDVWGKGTTVTVSS

SEQ ID NO: 787 - protein, 9 aa, Artificial Sequence
  Description of Artificial Sequence: Synthetic heavy chain variable region CDR H1
YRFSNYGIS

SEQ ID NO: 788 - DNA, 27 bp, Artificial Sequence
  Description of Artificial Sequence: Synthetic heavy chain variable region CDR H1
tacaggttttccaactatggtatcagc

SEQ ID NO: 789 - protein, 17 aa, Artificial Sequence
  Description of Artificial Sequence: Synthetic heavy chain variable region CDR H2
WISAYNGNIKYGNNLQG

SEQ ID NO: 790 - DNA, 51 bp, Artificial Sequence; identical to SEQ ID NO: 70
  Description of Artificial Sequence: Synthetic heavy chain variable region CDR H2

SEQ ID NO: 791 - protein, 14 aa, Artificial Sequence
  Description of Artificial Sequence: Synthetic heavy chain variable region CDR H3
ARDVPADGVHFMDV

SEQ ID NO: 792 - DNA, 42 bp, Artificial Sequence; identical to SEQ ID NO: 72
  Description of Artificial Sequence: Synthetic heavy chain variable region CDR H3

SEQ ID NO: 793 - DNA, 336 bp, Artificial Sequence
  Description of Artificial Sequence: Synthetic light chain variable region
gatattgtgatgactcagactccactctccctgcccgtcacccttggacagccggcctccatctcctgcaggtctagtcaaagcctcgtacacagtgatactaacacctacttgaactggtttcagcagaggccaggccaatctccacggcgcctaatttataaggtttctaaccgggactctggggtcccagacagattcagcggcagtgggtcaggcactactttcacactgaaaatcagcagggtggaggctgaggatgttgggatttattactgcatgcagggttcacactgggctccgactttcggccaggggaccaaggtggaaatcaaa

SEQ ID NO: 794 - protein, 112 aa, Artificial Sequence
  Description of Artificial Sequence: Synthetic light chain variable region
DIVMTQTPLSLPVTLGQPASISCRSSQSLVHSDTNTYLNWFQQRPGQSPRRLIYKVSNRDSGVPDRFSGSGSGTTFTLKISRVEAEDVGIYYCMQGSHWAPTFGQGTKVEIK

SEQ ID NO: 795 - protein, 16 aa, Artificial Sequence
  Description of Artificial Sequence: Synthetic light chain variable region CDR L1
RSSQSLVHSDTNTYLN

SEQ ID NO: 796 - DNA, 48 bp, Artificial Sequence; identical to SEQ ID NO: 76
  Description of Artificial Sequence: Synthetic light chain variable region CDR L1

SEQ ID NO: 797 - protein, 7 aa, Artificial Sequence
  Description of Artificial Sequence: Synthetic light chain variable region CDR L2
KVSNRDS

SEQ ID NO: 798 - DNA, 21 bp, Artificial Sequence
  Description of Artificial Sequence: Synthetic light chain variable region CDR L2
aaggtttctaaccgggactct

SEQ ID NO: 799 - protein, 9 aa, Artificial Sequence
  Description of Artificial Sequence: Synthetic light chain variable region CDR L3
MQGSHWAPT

SEQ ID NO: 800 - DNA, 27 bp, Artificial Sequence
  Description of Artificial Sequence: Synthetic light chain variable region CDR L3
atgcagggttcacactgggctccgact

SEQ ID NO: 801 - DNA, 366 bp, Artificial Sequence
  Description of Artificial Sequence: Synthetic heavy chain variable region
caggtccagctggtgcagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatggaagtaataaatactatgcagactccgtgaagggccgattcaccatctccagagacaattccaagaacacggtatatctgcaaatgaacagcctgagagccgacgacacggctgtctattactgtgcgagagatgcgatatttggcagtggccccaactggttcgacccctggggtcagggaaccctggtcaccgtctcctca

SEQ ID NO: 802 - protein, 122 aa, Artificial Sequence
  Description of Artificial Sequence: Synthetic heavy chain variable region
QVQLVQSGGGVVQPGRSLRLSCAASGFTFSNYGMHWVRQAPGKGLEWVAVIWYDGSNKYYADSVKGRFTISRDNSKNTVYLQMNSLRADDTAVYYCARDAIFGSGPNWFDPWGQGTLVTVSS

SEQ ID NO: 803 - protein, 9 aa, Artificial Sequence
  Description of Artificial Sequence: Synthetic heavy chain variable region CDR H1
FTFSNYGMH

SEQ ID NO: 804 - DNA, 27 bp, Artificial Sequence
  Description of Artificial Sequence: Synthetic heavy chain variable region CDR H1
ttcaccttcagtaactatggcatgcac

SEQ ID NO: 805 - protein, 17 aa, Artificial Sequence
  Description of Artificial Sequence: Synthetic heavy chain variable region CDR H2
VIWYDGSNKYYADSVKG

SEQ ID NO: 806 - DNA, 51 bp, Artificial Sequence
  Description of Artificial Sequence: Synthetic heavy chain variable region CDR H2
gttatatggtatgatggaagtaataaatactatgcagactccgtgaagggc

SEQ ID NO: 807 - protein, 15 aa, Artificial Sequence
  Description of Artificial Sequence: Synthetic heavy chain variable region CDR H3
ARDAIFGSGPNWFDP

SEQ ID NO: 808 - DNA, 45 bp, Artificial Sequence
  Description of Artificial Sequence: Synthetic heavy chain variable region CDR H3
gcgagagatgcgatatttggcagtggccccaactggttcgacccc

SEQ ID NO: 809 - DNA, 333 bp, Artificial Sequence
  Description of Artificial Sequence: Synthetic light chain variable region
cagtctgtcctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtagcagcaatcggccctcaggggtccctgaccggttctctggctccaagtctggcacctcagcctccctggccatcactgggctccaggctgaggatgaggctgattattactgccagtcctatgaaagcagcctgagaggttgggtgttcggcggagggaccaaggtcaccgtccta

SEQ ID NO: 810 - protein, 111 aa, Artificial Sequence
  Description of Artificial Sequence: Synthetic light chain variable region
QSVLTQPPSVSGAPGQRVTISCTGSSSNIGAGYDVHWYQQLPGTAPKLLIYGSSNRPSGVPDRFSGSKSGTSASLAITGLQAEDEADYYCQSYESSLRGWVFGGGTKVTVL

SEQ ID NO: 811 - protein, 14 aa, Artificial Sequence
  Description of Artificial Sequence: Synthetic light chain variable region CDR L1
TGSSSNIGAGYDVH

SEQ ID NO: 812 - DNA, 42 bp, Artificial Sequence
  Description of Artificial Sequence: Synthetic light chain variable region CDR L1
actgggagcagctccaacatcggggcaggttatgatgtacac

SEQ ID NO: 813 - protein, 7 aa, Artificial Sequence
  Description of Artificial Sequence: Synthetic light chain variable region CDR L2
GSSNRPS

SEQ ID NO: 814 - DNA, 21 bp, Artificial Sequence
  Description of Artificial Sequence: Synthetic light chain variable region CDR L2
ggtagcagcaatcggccctca

SEQ ID NO: 815 - protein, 11 aa, Artificial Sequence
  Description of Artificial Sequence: Synthetic light chain variable region CDR L3
QSYESSLRGWV

SEQ ID NO: 816 - DNA, 33 bp, Artificial Sequence
  Description of Artificial Sequence: Synthetic light chain variable region CDR L3
cagtcctatgaaagcagcctgagaggttgggtg

SEQ ID NO: 817 - DNA, 351 bp, Artificial Sequence; identical to SEQ ID NO: 369
  Description of Artificial Sequence: Synthetic heavy chain variable region

SEQ ID NO: 818 - protein, 117 aa, Artificial Sequence; identical to SEQ ID NO: 370
  Description of Artificial Sequence: Synthetic heavy chain variable region

SEQ ID NO: 819 - protein, 9 aa, Artificial Sequence
  Description of Artificial Sequence: Synthetic heavy chain variable region CDR H1
FTFSDHAMY

SEQ ID NO: 820 - DNA, 27 bp, Artificial Sequence
  Description of Artificial Sequence: Synthetic heavy chain variable region CDR H1
ttcaccttcagtgaccatgctatgtac

SEQ ID NO: 821 - protein, 17 aa, Artificial Sequence
  Description of Artificial Sequence: Synthetic heavy chain variable region CDR H2
LISFDGRNIYYADSVKG

SEQ ID NO: 822 - DNA, 51 bp, Artificial Sequence; identical to SEQ ID NO: 374
  Description of Artificial Sequence: Synthetic heavy chain variable region CDR H2

SEQ ID NO: 823 - protein, 10 aa, Artificial Sequence
  Description of Artificial Sequence: Synthetic heavy chain variable region CDR H3
ARDQWLVPDY

SEQ ID NO: 824 - DNA, 30 bp, Artificial Sequence; identical to SEQ ID NO: 376
  Description of Artificial Sequence: Synthetic heavy chain variable region CDR H3

SEQ ID NO: 825 - DNA, 327 bp, Artificial Sequence
  Description of Artificial Sequence: Synthetic light chain variable region
cagtctgttctgactcagcctgcctccgtgtctgggtctcctggacagtcgatcaccatctcctgcactggaaccagcagtgacgttggtggttataactatgtctcctggtaccaacagcacccaggcaacgcccccaaactcatgatttatgaagtcagtaagcggccctcaggggtccctgatcgcttctctggcttcaagtctggcaacacggcctccctgaccgtctctgggctccaggctgaggatgaggctgattattactgcagctcatatgcaggcagcaacagtgtcttcggaactgggaccaaggtcaccgtccta

SEQ ID NO: 826 - protein, 109 aa, Artificial Sequence
  Description of Artificial Sequence: Synthetic light chain variable region
QSVLTQPASVSGSPGQSITISCTGTSSDVGGYNYVSWYQQHPGNAPKLMIYEVSKRPSGVPDRFSGFKSGNTASLTVSGLQAEDEADYYCSSYAGSNSVFGTGTKVTVL

SEQ ID NO: 827 - protein, 14 aa, Artificial Sequence
  Description of Artificial Sequence: Synthetic light chain variable region CDR L1
TGTSSDVGGYNYVS

SEQ ID NO: 828 - DNA, 42 bp, Artificial Sequence; identical to SEQ ID NO: 380
  Description of Artificial Sequence: Synthetic light chain variable region CDR L1

SEQ ID NO: 829 - protein, 7 aa, Artificial Sequence
  Description of Artificial Sequence: Synthetic light chain variable region CDR L2
EVSKRPS

SEQ ID NO: 830 - DNA, 21 bp, Artificial Sequence
  Description of Artificial Sequence: Synthetic light chain variable region CDR L2
gaagtcagtaagcggccctca

SEQ ID NO: 831 - protein, 9 aa, Artificial Sequence
  Description of Artificial Sequence: Synthetic light chain variable region CDR L3
SSYAGSNSV

SEQ ID NO: 832 - DNA, 27 bp, Artificial Sequence
  Description of Artificial Sequence: Synthetic light chain variable region CDR L3
agctcatatgcaggcagcaacagtgtc

SEQ ID NO: 833 - DNA, 384 bp, Artificial Sequence
  Description of Artificial Sequence: Synthetic heavy chain variable region
gaggtgcagctggtggagtctgggggaggcttggtaaggccgggggggtcccttggactctcatgttcagcctctggattcattttcagtaacgcttggatgacctgggtccgccaggctccagggaagggactggagtgggtcggccatattaaaagcaaagttaatggtgggacaacagcctacggtgcacccgtgaaaggcagattcaccatctcaagagatgattcacgaaacacgctgtttctgcaaatgaacagcctgaaaaccgaggacacaggcgtgtattactgtactacaggcccaccctatcagtactttgatgattccggttattcggtcgtggactactggggccagggaaccctggtcaccgtctcctcc

SEQ ID NO: 834 - protein, 128 aa, Artificial Sequence
  Description of Artificial Sequence: Synthetic heavy chain variable region
EVQLVESGGGLVRPGGSLGLSCSASGFIFSNAWMTWVRQAPGKGLEWVGHIKSKVNGGTTAYGAPVKGRFTISRDDSRNTLFLQMNSLKTEDTGVYYCTTGPPYQYFDDSGYSVVDYWGQGTLVTVSS

SEQ ID NO: 835 - protein, 9 aa, Artificial Sequence
  Description of Artificial Sequence: Synthetic heavy chain variable region CDR H1
FIFSNAWMT

SEQ ID NO: 836 - DNA, 27 bp, Artificial Sequence
  Description of Artificial Sequence: Synthetic heavy chain variable region CDR H1
ttcattttcagtaacgcttggatgacc

SEQ ID NO: 837 - protein, 19 aa, Artificial Sequence
  Description of Artificial Sequence: Synthetic heavy chain variable region CDR H2
HIKSKVNGGTTAYGAPVKG

SEQ ID NO: 838 - DNA, 57 bp, Artificial Sequence
  Description of Artificial Sequence: Synthetic heavy chain variable region CDR H2
catattaaaagcaaagttaatggtgggacaacagcctacggtgcacccgtgaaaggc

SEQ ID NO: 839 - protein, 19 aa, Artificial Sequence
  Description of Artificial Sequence: Synthetic heavy chain variable region CDR H3
TTGPPYQYFDDSGYSVVDY

SEQ ID NO: 840 - DNA, 57 bp, Artificial Sequence
  Description of Artificial Sequence: Synthetic heavy chain variable region CDR H3
actacaggcccaccctatcagtactttgatgattccggttattcggtcgtggactac

SEQ ID NO: 841 - DNA, 330 bp, Artificial Sequence
  Description of Artificial Sequence: Synthetic light chain variable region
cagtctgtggtgacgcagccgccctcagcgtctgggacccccgggcagagggtcaccatctcttgttctggaagcgactccaacatcggaactgattatttttactggtaccagcagctcccaggatcggcccccaaactcctcatctatggtagtaatcagcggccctccggggtccctgaccgattctctggctcccagtctggctccgcagcctccctggccatcagtggcctccggtccgaggatgacgctgactattactgtgcagcatgggatgacagcctgggtggtccggtgttcggcggtgggaccaaggtcaccgtccta

SEQ ID NO: 842 - protein, 110 aa, Artificial Sequence
  Description of Artificial Sequence: Synthetic light chain variable region
QSVVTQPPSASGTPGQRVTISCSGSDSNIGTDYFYWYQQLPGSAPKLLIYGSNQRPSGVPDRFSGSQSGSAASLAISGLRSEDDADYYCAAWDDSLGGPVFGGGTKVTVL

SEQ ID NO: 843 - protein, 13 aa, Artificial Sequence
  Description of Artificial Sequence: Synthetic light chain variable region CDR L1
SGSDSNIGTDYFY

SEQ ID NO: 844 - DNA, 39 bp, Artificial Sequence
  Description of Artificial Sequence: Synthetic light chain variable region CDR L1
tctggaagcgactccaacatcggaactgattatttttac

SEQ ID NO: 845 - protein, 7 aa, Artificial Sequence
  Description of Artificial Sequence: Synthetic light chain variable region CDR L2
GSNQRPS

SEQ ID NO: 846 - DNA, 21 bp, Artificial Sequence
  Description of Artificial Sequence: Synthetic light chain variable region CDR L2
ggtagtaatcagcggccctcc

SEQ ID NO: 847 - protein, 11 aa, Artificial Sequence
  Description of Artificial Sequence: Synthetic light chain variable region CDR L3
AAWDDSLGGPV

SEQ ID NO: 848 - DNA, 33 bp, Artificial Sequence
  Description of Artificial Sequence: Synthetic light chain variable region CDR L3
gcagcatgggatgacagcctgggtggtccggtg

SEQ ID NO: 849 - DNA, 366 bp, Artificial Sequence
  Description of Artificial Sequence: Synthetic heavy chain variable region
caggtgcagctacagcagtggggcacaggactggtgaagccttcggagaccctgtccctaacctgcgcagtctctggtggggccttcagcggtcaccagtggaactggttccgccagccccccgggaagggtctggagtggattggagaaatcaatgtcagtggcaacacccactacaacgtgtccctcaggagtcgggtcaccatttctctggacgagtccaagaaacaattctccctgaaaatgacctctgtcaccgccgcggatacggctatttactactgtgcgaaagcctcgagtgggtcttatcacttcgagtattggttcgacccctggagccagggaacaatggtcaccgtctcctca

SEQ ID NO: 850 - protein, 122 aa, Artificial Sequence
  Description of Artificial Sequence: Synthetic heavy chain variable region
QVQLQQWGTGLVKPSETLSLTCAVSGGAFSGHQWNWFRQPPGKGLEWIGEINVSGNTHYNVSLRSRVTISLDESKKQFSLKMTSVTAADTAIYYCAKASSGSYHFEYWFDPWSQGTMVTVSS

SEQ ID NO: 851 - protein, 9 aa, Artificial Sequence
  Description of Artificial Sequence: Synthetic heavy chain variable region CDR H1
GAFSGHQWN

SEQ ID NO: 852 - DNA, 27 bp, Artificial Sequence
  Description of Artificial Sequence: Synthetic heavy chain variable region CDR H1
ggggccttcagcggtcaccagtggaac

SEQ ID NO: 853 - protein, 16 aa, Artificial Sequence
  Description of Artificial Sequence: Synthetic heavy chain variable region CDR H2
EINVSGNTHYNVSLRS

SEQ ID NO: 854 - DNA, 48 bp, Artificial Sequence
  Description of Artificial Sequence: Synthetic heavy chain variable region CDR H2
gaaatcaatgtcagtggcaacacccactacaacgtgtccctcaggagt

SEQ ID NO: 855 - protein, 16 aa, Artificial Sequence
  Description of Artificial Sequence: Synthetic heavy chain variable region CDR H3
AKASSGSYHFEYWFDP

SEQ ID NO: 856 - DNA, 48 bp, Artificial Sequence
  Description of Artificial Sequence: Synthetic heavy chain variable region CDR H3
gcgaaagcctcgagtgggtcttatcacttcgagtattggttcgacccc

SEQ ID NO: 857 - DNA, 324 bp, Artificial Sequence
  Description of Artificial Sequence: Synthetic light chain variable region
tcctatgagctgacacagccaccctcggtgtcagtggccccaggaaagatggcctggtttacctgtgggggaagcgacattggaagtaaaagagtccactggtaccagcagaagccgggccaggcccctgtcctgctcgtgtatgatgattccttacgtccctcagggacctctgcccgagtctctggctccacctctggcaacacggccaccctgagtatcatcagcgtcgaagccggggatgaggccgactatttttgtcaggtgtgggatgatgccgacgatcatgcggtgttcggcggagggaccaagctcaccgtccta

SEQ ID NO: 858 - protein, 108 aa, Artificial Sequence
  Description of Artificial Sequence: Synthetic light chain variable region
SYELTQPPSVSVAPGKMAWFTCGGSDIGSKRVHWYQQKPGQAPVLLVYDDSLRPSGTSARVSGSTSGNTATLSIISVEAGDEADYFCQVWDDADDHAVFGGGTKLTVL

SEQ ID NO: 859 - protein, 11 aa, Artificial Sequence
  Description of Artificial Sequence: Synthetic light chain variable region CDR L1
GGSDIGSKRVH

SEQ ID NO: 860 - DNA, 33 bp, Artificial Sequence
  Description of Artificial Sequence: Synthetic light chain variable region CDR L1
gggggaagcgacattggaagtaaaagagtccac

SEQ ID NO: 861 - protein, 7 aa, Artificial Sequence
  Description of Artificial Sequence: Synthetic light chain variable region CDR L2
DDSLRPS

SEQ ID NO: 862 - DNA, 21 bp, Artificial Sequence
  Description of Artificial Sequence: Synthetic light chain variable region CDR L2
gatgattccttacgtccctca

SEQ ID NO: 863 - protein, 11 aa, Artificial Sequence
  Description of Artificial Sequence: Synthetic light chain variable region CDR L3
QVWDDADDHAV

SEQ ID NO: 864 - DNA, 33 bp, Artificial Sequence
  Description of Artificial Sequence: Synthetic light chain variable region CDR L3
caggtgtgggatgatgccgacgatcatgcggtg

SEQ ID NO: 865 - DNA, 351 bp, Artificial Sequence; identical to SEQ ID NO: 369
  Description of Artificial Sequence: Synthetic heavy chain variable region

SEQ ID NO: 866 - protein, 117 aa, Artificial Sequence; identical to SEQ ID NO: 370
  Description of Artificial Sequence: Synthetic heavy chain variable region

SEQ ID NO: 867 - protein, 9 aa, Artificial Sequence
  Description of Artificial Sequence: Synthetic heavy chain variable region CDR H1
FTFSDHAMY

SEQ ID NO: 868 - DNA, 27 bp, Artificial Sequence
  Description of Artificial Sequence: Synthetic heavy chain variable region CDR H1
ttcaccttcagtgaccatgctatgtac

SEQ ID NO: 869 - protein, 17 aa, Artificial Sequence
  Description of Artificial Sequence: Synthetic heavy chain variable region CDR H2
LISFDGRNIYYADSVKG

SEQ ID NO: 870 - DNA, 51 bp, Artificial Sequence; identical to SEQ ID NO: 374
  Description of Artificial Sequence: Synthetic heavy chain variable region CDR H2

SEQ ID NO: 871 - protein, 10 aa, Artificial Sequence
  Description of Artificial Sequence: Synthetic heavy chain variable region CDR H3
ARDQWLVPDY

SEQ ID NO: 872 - DNA, 30 bp, Artificial Sequence; identical to SEQ ID NO: 376
  Description of Artificial Sequence: Synthetic heavy chain variable region CDR H3

SEQ ID NO: 873 - DNA, 327 bp, Artificial Sequence
  Description of Artificial Sequence: Synthetic light chain variable region
cagtctgctctgactcagcctgcctccgtgtctgggtctcctggacagtcgatcaccatctcctgcactggaaccagcagtgacgttggtggttataactatgtctcctggtaccaacagcacccaggcaacgcccccaaactcatgatttatgaagtcagtaagcggccctcaggggtccctgatcgcttctctggcttcaagtctggcaacacggcctccctgaccgtctctgggctccaggctgaggatgaggctgattattactgcagctcatatgcaggcagcaacagtgtcttcggaactgggaccaaggtgaccgtccta

SEQ ID NO: 874 - protein, 109 aa, Artificial Sequence
  Description of Artificial Sequence: Synthetic light chain variable region
QSALTQPASVSGSPGQSITISCTGTSSDVGGYNYVSWYQQHPGNAPKLMIYEVSKRPSGVPDRFSGFKSGNTASLTVSGLQAEDEADYYCSSYAGSNSVFGTGTKVTVL

SEQ ID NO: 875 - protein, 14 aa, Artificial Sequence
  Description of Artificial Sequence: Synthetic light chain variable region CDR L1
TGTSSDVGGYNYVS

SEQ ID NO: 876 - DNA, 42 bp, Artificial Sequence; identical to SEQ ID NO: 380
  Description of Artificial Sequence: Synthetic light chain variable region CDR L1

SEQ ID NO: 877 - protein, 7 aa, Artificial Sequence
  Description of Artificial Sequence: Synthetic light chain variable region CDR L2
EVSKRPS

SEQ ID NO: 878 - DNA, 21 bp, Artificial Sequence
  Description of Artificial Sequence: Synthetic light chain variable region CDR L2
gaagtcagtaagcggccctca

SEQ ID NO: 879 - protein, 9 aa, Artificial Sequence
  Description of Artificial Sequence: Synthetic light chain variable region CDR L3
SSYAGSNSV

SEQ ID NO: 880 - DNA, 27 bp, Artificial Sequence
  Description of Artificial Sequence: Synthetic light chain variable region CDR L3
agctcatatgcaggcagcaacagtgtc

SEQ ID NO: 881 - DNA, 378 bp, Artificial Sequence
  Description of Artificial Sequence: Synthetic heavy chain variable region
cagatcaccttgaaggagtctggtcctacgctggtgaaacccacacagaccctcacgctgacctgctccttctctgggttctcactcaccactcgtggagtgggtgtgggctgggtccgtcagcccccaggaaaggccctggagtgccttggattcgtttattgggacgatgataagcgctacagcccatctctgaggagcagactcaccatctccgaggacacgtccaaaaaccaggtggtccttacaatgaccaacatggaccctttggacacagccacgtattactgtgtacacagcgatctctatgatagaggtggttattacttattctactttgactactggggccagggaaccctggtcaccgtctcctca

SEQ ID NO: 882 - protein, 126 aa, Artificial Sequence
  Description of Artificial Sequence: Synthetic heavy chain variable region
QITLKESGPTLVKPTQTLTLTCSFSGFSLTTRGVGVGWVRQPPGKALECLGFVYWDDDKRYSPSLRSRLTISEDTSKNQVVLTMTNMDPLDTATYYCVHSDLYDRGGYYLFYFDYWGQGTLVTVSS

SEQ ID NO: 883 - protein, 11 aa, Artificial Sequence
  Description of Artificial Sequence: Synthetic heavy chain variable region CDR H1
FSLTTRGVGVG

SEQ ID NO: 884 - DNA, 33 bp, Artificial Sequence; identical to SEQ ID NO: 596
  Description of Artificial Sequence: Synthetic heavy chain variable region CDR H1

SEQ ID NO: 885 - protein, 16 aa, Artificial Sequence
  Description of Artificial Sequence: Synthetic heavy chain variable region CDR H2
FVYWDDDKRYSPSLRS

SEQ ID NO: 886 - DNA, 48 bp, Artificial Sequence
  Description of Artificial Sequence: Synthetic heavy chain variable region CDR H2
ttcgtttattgggacgatgataagcgctacagcccatctctgaggagc

SEQ ID NO: 887 - protein, 18 aa, Artificial Sequence
  Description of Artificial Sequence: Synthetic heavy chain variable region CDR H3
VHSDLYDRGGYYLFYFDY

SEQ ID NO: 888 - DNA, 54 bp, Artificial Sequence
  Description of Artificial Sequence: Synthetic heavy chain variable region CDR H3
gtacacagcgatctctatgatagaggtggttattacttattctactttgactac

SEQ ID NO: 889 - DNA, 321 bp, Artificial Sequence
  Description of Artificial Sequence: Synthetic light chain variable region
gatattgtgctgactcagtctccatcctccctgtctgcatctgtgggggacagagtcaccatcacttgccgggcaagtcagcccattgccagctatttaaattggtatcagcacaaaccagggaaagcccctaaactcctgatctatgctgcatccagtttgcagagtggggtctcatcaacattcagtggccggggatctgggacagatttcactctcaccatcaccgctctgcaacctgaagattttgcaatttactactgtcaacagagttacactttcccgtacacttttggccaggggaccaaagtggatatcaaa

SEQ ID NO: 890 - protein, 107 aa, Artificial Sequence
  Description of Artificial Sequence: Synthetic light chain variable region
DIVLTQSPSSLSASVGDRVTITCRASQPIASYLNWYQHKPGKAPKLLIYAASSLQSGVSSTFSGRGSGTDFTLTITALQPEDFAIYYCQQSYTFPYTFGQGTKVDIK

SEQ ID NO: 891 - protein, 11 aa, Artificial Sequence
  Description of Artificial Sequence: Synthetic light chain variable region CDR L1
RASQPIASYLN

SEQ ID NO: 892 - DNA, 33 bp, Artificial Sequence
  Description of Artificial Sequence: Synthetic light chain variable region CDR L1
cgggcaagtcagcccattgccagctatttaaat

SEQ ID NO: 893 - protein, 7 aa, Artificial Sequence
  Description of Artificial Sequence: Synthetic light chain variable region CDR L2
AASSLQS

SEQ ID NO: 894 - DNA, 21 bp, Artificial Sequence
  Description of Artificial Sequence: Synthetic light chain variable region CDR L2
gctgcatccagtttgcagagt

SEQ ID NO: 895 - protein, 9 aa, Artificial Sequence
  Description of Artificial Sequence: Synthetic light chain variable region CDR L3
QQSYTFPYT

SEQ ID NO: 896 - DNA, 27 bp, Artificial Sequence
  Description of Artificial Sequence: Synthetic light chain variable region CDR L3
caacagagttacactttcccgtacact

SEQ ID NO: 897 - DNA, 354 bp, Artificial Sequence
  Description of Artificial Sequence: Synthetic heavy chain variable region
caggtgcagctggtgcagtctggagcagaggtgaagaagccgggggagtctctgaagatctcctgtcaaggttctggatatagttttagaagttactggatcggttgggtgcgccagaagcccgggaaaggcctggaatatatgggcatcatctttcctaatgactttgataccagatacagcccgtccttccaaggccaggtcaccatctccgtcgacaagtccaccagcaccgccttcctgcagtggaccagcctgcaggcctcggacaccgccatatattattgtggcagacaagagctgcagggtagttttactatatggggccaagggacaatggtcaccgtcacttca

SEQ ID NO: 898 - protein, 118 aa, Artificial Sequence
  Description of Artificial Sequence: Synthetic heavy chain variable region
QVQLVQSGAEVKKPGESLKISCQGSGYSFRSYWIGWVRQKPGKGLEYMGIIFPNDFDTRYSPSFQGQVTISVDKSTSTAFLQWTSLQASDTAIYYCGRQELQGSFTIWGQGTMVTVTS

SEQ ID NO: 899 - protein, 9 aa, Artificial Sequence
  Description of Artificial Sequence: Synthetic heavy chain variable region CDR H1
YSFRSYWIG

SEQ ID NO: 900 - DNA, 27 bp, Artificial Sequence
  Description of Artificial Sequence: Synthetic heavy chain variable region CDR H1
tatagttttagaagttactggatcggt

SEQ ID NO: 901 - protein, 17 aa, Artificial Sequence
  Description of Artificial Sequence: Synthetic heavy chain variable region CDR H2
IIFPNDFDTRYSPSFQG

SEQ ID NO: 902 - DNA, 51 bp, Artificial Sequence
  Description of Artificial Sequence: Synthetic heavy chain variable region CDR H2
atcatctttcctaatgactttgataccagatacagcccgtccttccaaggc

SEQ ID NO: 903 - protein, 11 aa, Artificial Sequence
  Description of Artificial Sequence: Synthetic heavy chain variable region CDR H3
GRQELQGSFTI

SEQ ID NO: 904 - DNA, 33 bp, Artificial Sequence
  Description of Artificial Sequence: Synthetic heavy chain variable region CDR H3
ggcagacaagagctgcagggtagttttactata

SEQ ID NO: 905 - DNA, 324 bp, Artificial Sequence
  Description of Artificial Sequence: Synthetic light chain variable region
gatattgtgatgactcagtctccatcctccctgtccgcatctgtcggagacagagtcaccatcacttgccaggcgagtcaggacatgggcaattctttaaattggtatcagcaaaagtcagggaaagcccctaaactcctgatctacgatgcatcgtatttggattcaggggtcccatcaaggttcagtggcagtggatctgggacacattttactttcaccatcagcaccctgcagcctgaagatattgcaacatattactgtcaacattatgataatctcctcttattcactttcggccctgggaccaagctggagatcaaa

SEQ ID NO: 906 - protein, 108 aa, Artificial Sequence
  Description of Artificial Sequence: Synthetic light chain variable region
DIVMTQSPSSLSASVGDRVTITCQASQDMGNSLNWYQQKSGKAPKLLIYDASYLDSGVPSRFSGSGSGTHFTFTISTLQPEDIATYYCQHYDNLLLFTFGPGTKLEIK

SEQ ID NO: 907 - protein, 11 aa, Artificial Sequence
  Description of Artificial Sequence: Synthetic light chain variable region CDR L1
QASQDMGNSLN

SEQ ID NO: 908 - DNA, 33 bp, Artificial Sequence
  Description of Artificial Sequence: Synthetic light chain variable region CDR L1
caggcgagtcaggacatgggcaattctttaaat

SEQ ID NO: 909 - protein, 7 aa, Artificial Sequence
  Description of Artificial Sequence: Synthetic light chain variable region CDR L2
DASYLDS

SEQ ID NO: 910 - DNA, 21 bp, Artificial Sequence
  Description of Artificial Sequence: Synthetic light chain variable region CDR L2
gatgcatcgtatttggattca

SEQ ID NO: 911 - protein, 10 aa, Artificial Sequence
  Description of Artificial Sequence: Synthetic light chain variable region CDR L3
QHYDNLLLFT

SEQ ID NO: 912 - DNA, 30 bp, Artificial Sequence
  Description of Artificial Sequence: Synthetic light chain variable region CDR L3
caacattatgataatctcctcttattcact

SEQ ID NO: 913 - DNA, 378 bp, Artificial Sequence
  Description of Artificial Sequence: Synthetic heavy chain variable region
cagatcaccttgaaggagtctggtcctaccctggtgaaacccacacagaccctcacgctgacctgcaccttctctgggttctcactcaccactcgtggagtgggtgtgggctggatccgtcagcccccaggaaaggccctggagttcctaggattcattcattgggatgatgataagacctacagcccatctctgaggaggagactcaccatcaccaaggacacctccaacaacgaggtggtccttacaatgaccaacatggaccctgtggacacagccacatattactgtgtccacagcgatctctatgatagtggtggttattacttatactactttgactactggggccagggaaccctggtcaccgtctcctca

SEQ ID NO: 914 - protein, 126 aa, Artificial Sequence
  Description of Artificial Sequence: Synthetic heavy chain variable region
QITLKESGPTLVKPTQTLTLTCTFSGFSLTTRGVGVGWIRQPPGKALEFLGFIHWDDDKTYSPSLRRRLTITKDTSNNEVVLTMTNMDPVDTATYYCVHSDLYDSGGYYLYYFDYWGQGTLVTVSS

SEQ ID NO: 915 - protein, 11 aa, Artificial Sequence
  Description of Artificial Sequence: Synthetic heavy chain variable region CDR H1
FSLTTRGVGVG

SEQ ID NO: 916 - DNA, 33 bp, Artificial Sequence; identical to SEQ ID NO: 596
  Description of Artificial Sequence: Synthetic heavy chain variable region CDR H1

SEQ ID NO: 917 - protein, 16 aa, Artificial Sequence
  Description of Artificial Sequence: Synthetic heavy chain variable region CDR H2
FIHWDDDKTYSPSLRR

SEQ ID NO: 918 - DNA, 48 bp, Artificial Sequence
  Description of Artificial Sequence: Synthetic heavy chain variable region CDR H2
ttcattcattgggatgatgataagacctacagcccatctctgaggagg

SEQ ID NO: 919 - protein, 18 aa, Artificial Sequence
  Description of Artificial Sequence: Synthetic heavy chain variable region CDR H3
VHSDLYDSGGYYLYYFDY

SEQ ID NO: 920 - DNA, 54 bp, Artificial Sequence
  Description of Artificial Sequence: Synthetic heavy chain variable region CDR H3
gtccacagcgatctctatgatagtggtggttattacttatactactttgactac

SEQ ID NO: 921 - DNA, 321 bp, Artificial Sequence
  Description of Artificial Sequence: Synthetic light chain variable region
gaaattgtgatgacacagtctccatcctccctgtctgcatctgtgggggacagagtcaccatcacttgccgggcaagtcagcccattcccagttatgtaaattggtatcagcagagaccagggaaagcccctaagctcctgatctatgctgcatccaatttgcagagtggggtctcatcaaaatttagtggcaggggatttgggacagatttcactctcaccatcgacactctgcaacctgaagattttgcaacttactactgtcaacaggtttacacttccccgtacacttttggccaggggaccaagctggagatcaaa

SEQ ID NO: 922 - protein, 107 aa, Artificial Sequence
  Description of Artificial Sequence: Synthetic light chain variable region
EIVMTQSPSSLSASVGDRVTITCRASQPIPSYVNWYQQRPGKAPKLLIYAASNLQSGVSSKFSGRGFGTDFTLTIDTLQPEDFATYYCQQVYTSPYTFGQGTKLEIK

SEQ ID NO: 923 - protein, 11 aa, Artificial Sequence
  Description of Artificial Sequence: Synthetic light chain variable region CDR L1
RASQPIPSYVN

SEQ ID NO: 924 - DNA, 33 bp, Artificial Sequence
  Description of Artificial Sequence: Synthetic light chain variable region CDR L1
cgggcaagtcagcccattcccagttatgtaaat

SEQ ID NO: 925 - protein, 7 aa, Artificial Sequence
  Description of Artificial Sequence: Synthetic light chain variable region CDR L2
AASNLQS

SEQ ID NO: 926 - DNA, 21 bp, Artificial Sequence
  Description of Artificial Sequence: Synthetic light chain variable region CDR L2
gctgcatccaatttgcagagt

SEQ ID NO: 927 - protein, 9 aa, Artificial Sequence
  Description of Artificial Sequence: Synthetic light chain variable region CDR L3
QQVYTSPYT

SEQ ID NO: 928 - DNA, 27 bp, Artificial Sequence
  Description of Artificial Sequence: Synthetic light chain variable region CDR L3
caacaggtttacacttccccgtacact

SEQ ID NO: 929 - DNA, 378 bp, Artificial Sequence
  Description of Artificial Sequence: Synthetic heavy chain variable region
gaggtgcagctggtggagtctggtcctacgctggtgaagcccacacagaccctcacgctgacctgcaccttctctgggttctcactcaccactcgtggaatgggtgtgggctggatccgtcagcccccaggcaggtccctggaatggcttgcagtcatttattgggatggtgatgtgcgctacagtccatctctgaagggcaggctcaccatcaccaaagacacccccaaaaaccaggtggtccttacaatgaccaacatggaccctgtggacacagccacatattactgtgtacacagcgatctctatgataggaatgcttattacctgcactactttgacttctggggccaaggaaccctggtcaccgtctcctca

SEQ ID NO: 930 - protein, 126 aa, Artificial Sequence
  Description of Artificial Sequence: Synthetic heavy chain variable region
EVQLVESGPTLVKPTQTLTLTCTFSGFSLTTRGMGVGWIRQPPGRSLEWLAVIYWDGDVRYSPSLKGRLTITKDTPKNQVVLTMTNMDPVDTATYYCVHSDLYDRNAYYLHYFDFWGQGTLVTVSS

SEQ ID NO: 931 - protein, 11 aa, Artificial Sequence
  Description of Artificial Sequence: Synthetic heavy chain variable region CDR H1
FSLTTRGMGVG

SEQ ID NO: 932 - DNA, 33 bp, Artificial Sequence
  Description of Artificial Sequence: Synthetic heavy chain variable region CDR H1
ttctcactcaccactcgtggaatgggtgtgggc

SEQ ID NO: 933 - protein, 16 aa, Artificial Sequence
  Description of Artificial Sequence: Synthetic heavy chain variable region CDR H2
VIYWDGDVRYSPSLKG

SEQ ID NO: 934 - DNA, 48 bp, Artificial Sequence
  Description of Artificial Sequence: Synthetic heavy chain variable region CDR H2
gtcatttattgggatggtgatgtgcgctacagtccatctctgaagggc

SEQ ID NO: 935 - protein, 18 aa, Artificial Sequence
  Description of Artificial Sequence: Synthetic heavy chain variable region CDR H3
VHSDLYDRNAYYLHYFDF

SEQ ID NO: 936 - DNA, 54 bp, Artificial Sequence
  Description of Artificial Sequence: Synthetic heavy chain variable region CDR H3
gtacacagcgatctctatgataggaatgcttattacctgcactactttgacttc

SEQ ID NO: 937 - DNA, 321 bp, Artificial Sequence
  Description of Artificial Sequence: Synthetic light chain variable region
gacatccggttgacccagtctccatcctccctgtctgcatctgtaggagacagagtcaccatcacttgccgggcaagtcagattattgccagttatttaaattggtatcagcagaaaccagggaaagcccctaacctcctgatctttgctgcatccagtttgcaaagtggggtcccatcaaggttccgtggcagtggatctgggacagatttcactctcaccataagcagtctgcaacctgaagactttgcaacttactactgtcaacagagttacagtataccgtacacttttggccaggggaccaagctggagatcaaa

SEQ ID NO: 938 - protein, 107 aa, Artificial Sequence
  Description of Artificial Sequence: Synthetic light chain variable region
DIRLTQSPSSLSASVGDRVTITCRASQIIASYLNWYQQKPGKAPNLLIFAASSLQSGVPSRFRGSGSGTDFTLTISSLQPEDFATYYCQQSYSIPYTFGQGTKLEIK

SEQ ID NO: 939 - protein, 11 aa, Artificial Sequence
  Description of Artificial Sequence: Synthetic light chain variable region CDR L1
RASQIIASYLN

SEQ ID NO: 940 - DNA, 33 bp, Artificial Sequence
  Description of Artificial Sequence: Synthetic light chain variable region CDR L1
cgggcaagtcagattattgccagttatttaaat

SEQ ID NO: 941 - protein, 7 aa, Artificial Sequence
  Description of Artificial Sequence: Synthetic light chain variable region CDR L2
AASSLQS

SEQ ID NO: 942 - DNA, 21 bp, Artificial Sequence
  Description of Artificial Sequence: Synthetic light chain variable region CDR L2
gctgcatccagtttgcaaagt

SEQ ID NO: 943 - protein, 9 aa, Artificial Sequence
  Description of Artificial Sequence: Synthetic light chain variable region CDR L3
QQSYSIPYT

SEQ ID NO: 944 - DNA, 27 bp, Artificial Sequence
  Description of Artificial Sequence: Synthetic light chain variable region CDR L3
caacagagttacagtataccgtacact

SEQ ID NO: 945 - DNA, 378 bp, Artificial Sequence
  Description of Artificial Sequence: Synthetic heavy chain variable region
caggtccagctggtgcagtctggtcctgcactggtgaaacccacacagaccctcacgctgacctgcaccttctctggattctcactcaccactcgtggagtgggtgtgggctggatccgtcagaccccaggaaaggccctggagtgccttggattcatttattgggatgatgatatgaactacaacccatctctgaggggcagagtcaccatcaccagggacacctccaaaaaccaggtggtcctaacaatgaccaacatggcccctgtggacacaggcacatattactgtgtacacagcgatctctatgatagtagcggttattatttatattactttgactactggggccagggaaccctggtcaccgtctcctca

SEQ ID NO: 946 - protein, 126 aa, Artificial Sequence
  Description of Artificial Sequence: Synthetic heavy chain variable region
QVQLVQSGPALVKPTQTLTLTCTFSGFSLTTRGVGVGWIRQTPGKALECLGFIYWDDDMNYNPSLRGRVTITRDTSKNQVVLTMTNMAPVDTGTYYCVHSDLYDSSGYYLYYFDYWGQGTLVTVSS

SEQ ID NO: 947 - protein, 11 aa, Artificial Sequence
  Description of Artificial Sequence: Synthetic heavy chain variable region CDR H1
FSLTTRGVGVG

SEQ ID NO: 948 - DNA, 33 bp, Artificial Sequence; identical to SEQ ID NO: 596
  Description of Artificial Sequence: Synthetic heavy chain variable region CDR H1

SEQ ID NO: 949 - protein, 16 aa, Artificial Sequence
  Description of Artificial Sequence: Synthetic heavy chain variable region CDR H2
FIYWDDDMNYNPSLRG

SEQ ID NO: 950 - DNA, 48 bp, Artificial Sequence
  Description of Artificial Sequence: Synthetic heavy chain variable region CDR H2
ttcatttattgggatgatgatatgaactacaacccatctctgaggggc

SEQ ID NO: 951 - protein, 18 aa, Artificial Sequence
  Description of Artificial Sequence: Synthetic heavy chain variable region CDR H3
VHSDLYDSSGYYLYYFDY

SEQ ID NO: 952 - DNA, 54 bp, Artificial Sequence
  Description of Artificial Sequence: Synthetic heavy chain variable region CDR H3
gtacacagcgatctctatgatagtagcggttattatttatattactttgactac

SEQ ID NO: 953 - DNA, 321 bp, Artificial Sequence
  Description of Artificial Sequence: Synthetic light chain variable region
gacatccggttgacccagtctccatcctccctgtctgcatctgtgggggacagagtcaccatcacttgccgggcaagtcagcccattgccagttatttaaattggtatcagcagaaaccagggaaagcccctaaactcctgatctatgctgcatccaatttgcagagtggggtcccttcaacattcagtggcaggggatctgggacagatttctctctcaccatctccactctgcaacctgaagacattgcaacttactactgtcaacagagttacacctccccctacacttttggccaggggaccaaggtggagatcaaa

SEQ ID NO: 954 - protein, 107 aa, Artificial Sequence
  Description of Artificial Sequence: Synthetic light chain variable region
DIRLTQSPSSLSASVGDRVTITCRASQPIASYLNWYQQKPGKAPKLLIYAASNLQSGVPSTFSGRGSGTDFSLTISTLQPEDIATYYCQQSYTSPYTFGQGTKVEIK

SEQ ID NO: 955 - protein, 11 aa, Artificial Sequence
  Description of Artificial Sequence: Synthetic light chain variable region CDR L1
RASQPIASYLN

SEQ ID NO: 956 - DNA, 33 bp, Artificial Sequence; identical to SEQ ID NO: 620
  Description of Artificial Sequence: Synthetic light chain variable region CDR L1

SEQ ID NO: 957 - protein, 7 aa, Artificial Sequence
  Description of Artificial Sequence: Synthetic light chain variable region CDR L2
AASNLQS

SEQ ID NO: 958 - DNA, 21 bp, Artificial Sequence
  Description of Artificial Sequence: Synthetic light chain variable region CDR L2
gctgcatccaatttgcagagt

SEQ ID NO: 959 - protein, 9 aa, Artificial Sequence
  Description of Artificial Sequence: Synthetic light chain variable region CDR L3
QQSYTSPYT

SEQ ID NO: 960 - DNA, 27 bp, Artificial Sequence
  Description of Artificial Sequence: Synthetic light chain variable region CDR L3
caacagagttacacctccccctacact

SEQ ID NO: 961 - DNA, 384 bp, Artificial Sequence
  Description of Artificial Sequence: Synthetic heavy chain variable region
gaggtgcagctgttggagtctgggggaggcctggttaagccgggggggtcccttagactctcatgtgcagcctctggattcattttcaataacgcctggatgacctgggtccgccaggctccagggagggggctggagtgggttggccgtataaaaaccaatgctgatggtgggactgcagactacagtacacccgtgaaaggcagattcgccatctcaagagatgattctacaaacacgctgtatctgcaaatgaacagcctgaaaaccgaggacacagccgtctattactgtaccacaggcccaccctataagtactctgacagtactggttattcggtcgttgactactggggccagggcaccctggtcactgtctcttca

SEQ ID NO: 962 - protein, 128 aa, Artificial Sequence
  Description of Artificial Sequence: Synthetic heavy chain variable region
EVQLLESGGGLVKPGGSLRLSCAASGFIFNNAWMTWVRQAPGRGLEWVGRIKTNADGGTADYSTPVKGRFAISRDDSTNTLYLQMNSLKTEDTAVYYCTTGPPYKYSDSTGYSVVDYWGQGTLVTVSS

SEQ ID NO: 963 - protein, 9 aa, Artificial Sequence
  Description of Artificial Sequence: Synthetic heavy chain variable region CDR H1
FIFNNAWMT

SEQ ID NO: 964 - DNA, 27 bp, Artificial Sequence
  Description of Artificial Sequence: Synthetic heavy chain variable region CDR H1
ttcattttcaataacgcctggatgacc

SEQ ID NO: 965 - protein, 19 aa, Artificial Sequence
  Description of Artificial Sequence: Synthetic heavy chain variable region CDR H2
RIKTNADGGTADYSTPVKG

SEQ ID NO: 966 - DNA, 57 bp, Artificial Sequence
  Description of Artificial Sequence: Synthetic heavy chain variable region CDR H2
cgtataaaaaccaatgctgatggtgggactgcagactacagtacacccgtgaaaggc

SEQ ID NO: 967 - protein, 19 aa, Artificial Sequence
  Description of Artificial Sequence: Synthetic heavy chain variable region CDR H3
TTGPPYKYSDSTGYSVVDY

SEQ ID NO: 968 - DNA, 57 bp, Artificial Sequence
  Description of Artificial Sequence: Synthetic heavy chain variable region CDR H3
accacaggcccaccctataagtactctgacagtactggttattcggtcgttgactac

SEQ ID NO: 969 - DNA, 330 bp, Artificial Sequence
  Description of Artificial Sequence: Synthetic light chain variable region
tcctatgagctgacgcagccaccctcagcgtctgggacccccgggcagagggtcaccatctcttgttctggaagcagctccaacatcggaagtaattatgtatattggtaccagcagctcccaggaacggcccccaaactcctcatctatagtactaatcagcggccctcaggggtccctgaccgattctctggctcccagtctggcacctcagcctccctggccatcagtgggctccggtccgaggatgaggctgattattactgtgcagcgtgggatgaccgcctgagtggtccggtgttcggcgggggcacccagctgaccgtcctc

SEQ ID NO: 970 - protein, 110 aa, Artificial Sequence
  Description of Artificial Sequence: Synthetic light chain variable region
SYELTQPPSASGTPGQRVTISCSGSSSNIGSNYVYWYQQLPGTAPKLLIYSTNQRPSGVPDRFSGSQSGTSASLAISGLRSEDEADYYCAAWDDRLSGPVFGGGTQLTVL

SEQ ID NO: 971 - protein, 13 aa, Artificial Sequence
  Description of Artificial Sequence: Synthetic light chain variable region CDR L1
SGSSSNIGSNYVY

SEQ ID NO: 972 - DNA, 39 bp, Artificial Sequence
  Description of Artificial Sequence: Synthetic light chain variable region CDR L1
tctggaagcagctccaacatcggaagtaattatgtatat

SEQ ID NO: 973 - protein, 7 aa, Artificial Sequence
  Description of Artificial Sequence: Synthetic light chain variable region CDR L2
STNQRPS

SEQ ID NO: 974 - DNA, 21 bp, Artificial Sequence
  Description of Artificial Sequence: Synthetic light chain variable region CDR L2
agtactaatcagcggccctca

SEQ ID NO: 975 - protein, 11 aa, Artificial Sequence
  Description of Artificial Sequence: Synthetic light chain variable region CDR L3
AAWDDRLSGPV

SEQ ID NO: 976 - DNA, 33 bp, Artificial Sequence
  Description of Artificial Sequence: Synthetic light chain variable region CDR L3
gcagcgtgggatgaccgcctgagtggtccggtg

SEQ ID NO: 977 - DNA, 363 bp, Artificial Sequence
  Description of Artificial Sequence: Synthetic heavy chain variable region
caggtccagcttgtgcagtctggggctgaggtgaagaagccggggtcctcggtgaaaatctcctgtaaggcttctggaggcaccttcaaaagtcaagctattcactgggtgcgacaggcccctggacaagggcttgagtggatgggaaacatcatccctacctacggatcaccaaacttcgcgcagaggttcctcggcagggtcaccttcattgcggacgattccactggcgctgcctccatggacctgtataggctgacatctgaggacacggccgtctattactgtgcgacagccgggtggttcggagaattagtgcggtttgactcctggggccagggaaccctggtcaccgtctcctca

SEQ ID NO: 978 - protein, 121 aa, Artificial Sequence
  Description of Artificial Sequence: Synthetic heavy chain variable region
QVQLVQSGAEVKKPGSSVKISCKASGGTFKSQAIHWVRQAPGQGLEWMGNIIPTYGSPNFAQRFLGRVTFIADDSTGAASMDLYRLTSEDTAVYYCATAGWFGELVRFDSWGQGTLVTVSS

SEQ ID NO: 979 - protein, 9 aa, Artificial Sequence
  Description of Artificial Sequence: Synthetic heavy chain variable region CDR H1
GTFKSQAIH

SEQ ID NO: 980 - DNA, 27 bp, Artificial Sequence
  Description of Artificial Sequence: Synthetic heavy chain variable region CDR H1
ggcaccttcaaaagtcaagctattcac

SEQ ID NO: 981 - protein, 17 aa, Artificial Sequence
  Description of Artificial Sequence: Synthetic heavy chain variable region CDR H2
NIIPTYGSPNFAQRFLG

SEQ ID NO: 982 - DNA, 51 bp, Artificial Sequence
  Description of Artificial Sequence: Synthetic heavy chain variable region CDR H2
aacatcatccctacctacggatcaccaaacttcgcgcagaggttcctcggc

SEQ ID NO: 983 - protein, 14 aa, Artificial Sequence
  Description of Artificial Sequence: Synthetic heavy chain variable region CDR H3
ATAGWFGELVRFDS

SEQ ID NO: 984 - DNA, 42 bp, Artificial Sequence
  Description of Artificial Sequence: Synthetic heavy chain variable region CDR H3
gcgacagccgggtggttcggagaattagtgcggtttgactcc

SEQ ID NO: 985 - DNA, 324 bp, Artificial Sequence
  Description of Artificial Sequence: Synthetic light chain variable region
gatattgtgatgactcagtctccagccaccctgtctgtgtctccaggggaaagagccaccctctcctgcagggccactgagagtattagcagcaacttagcctggtaccagcagaaacctggccaggctcccaggctcctcatctatggtgcatccaccagggccactggtatcccagccaggttcagtggcagtgggtcagggacagagttcactctcaccatcaacagcctgcagtctgaagattttgcagtttattactgtcagcagtataataactggcctcctctcactttcggcggagggaccaaagtggatatcaaa

SEQ ID NO: 986 - protein, 108 aa, Artificial Sequence
  Description of Artificial Sequence: Synthetic light chain variable region
DIVMTQSPATLSVSPGERATLSCRATESISSNLAWYQQKPGQAPRLLIYGASTRATGIPARFSGSGSGTEFTLTINSLQSEDFAVYYCQQYNNWPPLTFGGGTKVDIK

SEQ ID NO: 987 - protein, 11 aa, Artificial Sequence
  Description of Artificial Sequence: Synthetic light chain variable region CDR L1
RATESISSNLA

SEQ ID NO: 988 - DNA, 33 bp, Artificial Sequence
  Description of Artificial Sequence: Synthetic light chain variable region CDR L1
agggccactgagagtattagcagcaacttagcc

SEQ ID NO: 989 - protein, 7 aa, Artificial Sequence
  Description of Artificial Sequence: Synthetic light chain variable region CDR L2
GASTRAT

SEQ ID NO: 990 - DNA, 21 bp, Artificial Sequence
  Description of Artificial Sequence: Synthetic light chain variable region CDR L2
ggtgcatccaccagggccact

SEQ ID NO: 991 - protein, 10 aa, Artificial Sequence
  Description of Artificial Sequence: Synthetic light chain variable region CDR L3
QQYNNWPPLT

SEQ ID NO: 992 - DNA, 30 bp, Artificial Sequence; identical to SEQ ID NO: 64
  Description of Artificial Sequence: Synthetic light chain variable region CDR L3

SEQ ID NO: 993 - DNA, 369 bp, Artificial Sequence
  Description of Artificial Sequence: Synthetic heavy chain variable region
caggtccagctggtgcagtctggggctgaggtgaagaagcctgggtcctcggtgaaggtctcctgcaaggcttcaggagacaccttcagcatgtatgctatcagctgggtgcgacaggcccctggacaaggacttgagtggatgggaggggtcctcccaatgttagggacctcaaactacgcacaacagttccggggcagagtcacgataacggcggacggatccacgagcacagcctacatggagatgagcaacctgagatttgaggacacggccgtttattactgtgcgagggtggccggtctggggaacagctatggtcgctactttgacgtctggggtcagggaaccctggtcaccgtctcctca

SEQ ID NO: 994 - protein, 123 aa, Artificial Sequence
  Description of Artificial Sequence: Synthetic heavy chain variable region
QVQLVQSGAEVKKPGSSVKVSCKASGDTFSMYAISWVRQAPGQGLEWMGGVLPMLGTSNYAQQFRGRVTITADGSTSTAYMEMSNLRFEDTAVYYCARVAGLGNSYGRYFDVWGQGTLVTVSS

SEQ ID NO: 995 - protein, 9 aa, Artificial Sequence
  Description of Artificial Sequence: Synthetic heavy chain variable region CDR H1
DTFSMYAIS

SEQ ID NO: 996 - DNA, 27 bp, Artificial Sequence
  Description of Artificial Sequence: Synthetic heavy chain variable region CDR H1
gacaccttcagcatgtatgctatcagc

SEQ ID NO: 997 - protein, 17 aa, Artificial Sequence
  Description of Artificial Sequence: Synthetic heavy chain variable region CDR H2
GVLPMLGTSNYAQQFRG

SEQ ID NO: 998 - DNA, 51 bp, Artificial Sequence
  Description of Artificial Sequence: Synthetic heavy chain variable region CDR H2
ggggtcctcccaatgttagggacctcaaactacgcacaacagttccggggc

SEQ ID NO: 999 - protein, 16 aa, Artificial Sequence
  Description of Artificial Sequence: Synthetic heavy chain variable region CDR H3
ARVAGLGNSYGRYFDV

SEQ ID NO: 1000 - DNA, 48 bp, Artificial Sequence
  Description of Artificial Sequence: Synthetic heavy chain variable region CDR H3
gcgagggtggccggtctggggaacagctatggtcgctactttgacgtc

SEQ ID NO: 1001 - DNA, 321 bp, Artificial Sequence
  Description of Artificial Sequence: Synthetic light chain variable region
gacatccggatgacccagtctccatcttctgtgtctgcatctattggggacagagtcaccatcacttgtcgggcgagtcaggatatcagcacctcgttagcctggtatcagcaaagaccagggaaagcccctaatctcctgatctatgctgcgtccactttacacagtggggtcccatcgaggttcaggggcagtgaatctggcccagacttcactctcactatcagcagcctgcagcctgaagatgtcggaacttactattgtcaacaggcaaagagtttcccgtacacttttggccaggggaccaagctggagatcaaa

SEQ ID NO: 1002 - protein, 107 aa, Artificial Sequence
  Description of Artificial Sequence: Synthetic light chain variable region
DIRMTQSPSSVSASIGDRVTITCRASQDISTSLAWYQQRPGKAPNLLIYAASTLHSGVPSRFRGSESGPDFTLTISSLQPEDVGTYYCQQAKSFPYTFGQGTKLEIK

SEQ ID NO: 1003 - protein, 11 aa, Artificial Sequence
  Description of Artificial Sequence: Synthetic light chain variable region CDR L1
RASQDISTSLA

SEQ ID NO: 1004 - DNA, 33 bp, Artificial Sequence
  Description of Artificial Sequence: Synthetic light chain variable region CDR L1
cgggcgagtcaggatatcagcacctcgttagcc

SEQ ID NO: 1005 - protein, 7 aa, Artificial Sequence
  Description of Artificial Sequence: Synthetic light chain variable region CDR L2
AASTLHS

SEQ ID NO: 1006 - DNA, 21 bp, Artificial Sequence
  Description of Artificial Sequence: Synthetic light chain variable region CDR L2
gctgcgtccactttacacagt

SEQ ID NO: 1007 - protein, 9 aa, Artificial Sequence
  Description of Artificial Sequence: Synthetic light chain variable region CDR L3
QQAKSFPYT

SEQ ID NO: 1008 - DNA, 27 bp, Artificial Sequence
  Description of Artificial Sequence: Synthetic light chain variable region CDR L3
caacaggcaaagagtttcccgtacact

SEQ ID NO: 1009 - DNA, 375 bp, Artificial Sequence
  Description of Artificial Sequence: Synthetic heavy chain variable region
caggtccagcttgtgcagtctgggggaggcctggtcaagcctggggggtccctgagactctcctgtgcagcttctggattcagcctcacaaactacagaatgaactgggtccgccaggctccagggaaggggctggagtgggtctcatcccttaaggattctagttcttacatctactacgcagactcagtgaagggccgattcaccgtctccagagacgacgcgaagaattcattctttttgcaaatgaccaatgtaagagccgaggacacggctgtttattactgtgcgagagagggatcggacacggagtattggaggctgacgccccccatggacgtctggggcaacgggaccacggtcaccgtctcctca

SEQ ID NO: 1010 - protein, 125 aa, Artificial Sequence
  Description of Artificial Sequence: Synthetic heavy chain variable region
QVQLVQSGGGLVKPGGSLRLSCAASGFSLTNYRMNWVRQAPGKGLEWVSSLKDSSSYIYYADSVKGRFTVSRDDAKNSFFLQMTNVRAEDTAVYYCAREGSDTEYWRLTPPMDVWGNGTTVTVSS

SEQ ID NO: 1011 - protein, 9 aa, Artificial Sequence
  Description of Artificial Sequence: Synthetic heavy chain variable region CDR H1
FSLTNYRMN

SEQ ID NO: 1012 - DNA, 27 bp, Artificial Sequence
  Description of Artificial Sequence: Synthetic heavy chain variable region CDR H1
ttcagcctcacaaactacagaatgaac

SEQ ID NO: 1013 - protein, 17 aa, Artificial Sequence
  Description of Artificial Sequence: Synthetic heavy chain variable region CDR H2
SLKDSSSYIYYADSVKG

SEQ ID NO: 1014 - DNA, 51 bp, Artificial Sequence
  Description of Artificial Sequence: Synthetic heavy chain variable region CDR H2
tcccttaaggattctagttcttacatctactacgcagactcagtgaagggc

SEQ ID NO: 1015 - protein, 18 aa, Artificial Sequence
  Description of Artificial Sequence: Synthetic heavy chain variable region CDR H3
AREGSDTEYWRLTPPMDV

SEQ ID NO: 1016 - DNA, 54 bp, Artificial Sequence
  Description of Artificial Sequence: Synthetic heavy chain variable region CDR H3
gcgagagagggatcggacacggagtattggaggctgacgccccccatggacgtc

SEQ ID NO: 1017 - DNA, 324 bp, Artificial Sequence
  Description of Artificial Sequence: Synthetic light chain variable region
cagtctgtgttgacgcagccgccctcggtgtcagtggccccacgacagacggccaggattacctgtggggagcacaacattggaactaaaagtgtgcactggtaccagcagaagccaggccaggcccctgtcctggtcatctatgatgacagcgaccggccctcagggatccctgcgcgattctctggctccaactctgggaacacggccaccctgaccatcagctgggtcgaagccggggatgaggccgtctattactgtcaggtgtgggactcaggtgatcatccttggctgttcggcggaggcacccagctgaccgtcctc

SEQ ID NO: 1018 - protein, 108 aa, Artificial Sequence
  Description of Artificial Sequence: Synthetic light chain variable region
QSVLTQPPSVSVAPRQTARITCGEHNIGTKSVHWYQQKPGQAPVLVIYDDSDRPSGIPARFSGSNSGNTATLTISWVEAGDEAVYYCQVWDSGDHPWLFGGGTQLTVL

SEQ ID NO: 1019 - protein, 11 aa, Artificial Sequence
  Description of Artificial Sequence: Synthetic light chain variable region CDR L1
GEHNIGTKSVH

SEQ ID NO: 1020 - DNA, 33 bp, Artificial Sequence
  Description of Artificial Sequence: Synthetic light chain variable region CDR L1
ggggagcacaacattggaactaaaagtgtgcac

SEQ ID NO: 1021 - protein, 7 aa, Artificial Sequence
  Description of Artificial Sequence: Synthetic light chain variable region CDR L2
DDSDRPS

SEQ ID NO: 1022 - DNA, 21 bp, Artificial Sequence
  Description of Artificial Sequence: Synthetic light chain variable region CDR L2
gatgacagcgaccggccctca

SEQ ID NO: 1023 - protein, 11 aa, Artificial Sequence
  Description of Artificial Sequence: Synthetic light chain variable region CDR L3
QVWDSGDHPWL

SEQ ID NO: 1024 - DNA, 33 bp, Artificial Sequence
  Description of Artificial Sequence: Synthetic light chain variable region CDR L3
caggtgtgggactcaggtgatcatccttggctg

SEQ ID NO: 1025 - DNA, 366 bp, Artificial Sequence
  Description of Artificial Sequence: Synthetic heavy chain variable region
gaggtgcagctggtggagtcagggggaggcttggtacagccgggggggtccctgagactctcctgtgcagcctctggattccccttcagtcgttataacatgaactgggtccgccaggctccagggaaggggctggagtgggtttcatacattagtagtggtagtcgaagcatttactacgcagactctgtgaagggccgattcaccatctccagagacaatgccaagaactcactgtatctgcaaatgaacagcctgagagccgaggacacggctgtatattactgtgcgagagacttaagcggatctccagcatatagcggcagctgggtctggggccagggaaccctggtcaccgtctcctca

SEQ ID NO: 1026 - protein, 122 aa, Artificial Sequence
  Description of Artificial Sequence: Synthetic heavy chain variable region
EVQLVESGGGLVQPGGSLRLSCAASGFPFSRYNMNWVRQAPGKGLEWVSYISSGSRSIYYADSVKGRFTISRDNAKNSLYLQMNSLRAEDTAVYYCARDLSGSPAYSGSWVWGQGTLVTVSS

SEQ ID NO: 1027 - protein, 9 aa, Artificial Sequence
  Description of Artificial Sequence: Synthetic heavy chain variable region CDR H1
FPFSRYNMN

SEQ ID NO: 1028 - DNA, 27 bp, Artificial Sequence
  Description of Artificial Sequence: Synthetic heavy chain variable region CDR H1
ttccccttcagtcgttataacatgaac

SEQ ID NO: 1029 - protein, 17 aa, Artificial Sequence
  Description of Artificial Sequence: Synthetic heavy chain variable region CDR H2
YISSGSRSIYYADSVKG

SEQ ID NO: 1030 - DNA, 51 bp, Artificial Sequence
  Description of Artificial Sequence: Synthetic heavy chain variable region CDR H2
tacattagtagtggtagtcgaagcatttactacgcagactctgtgaagggc

SEQ ID NO: 1031 - protein, 15 aa, Artificial Sequence
  Description of Artificial Sequence: Synthetic heavy chain variable region CDR H3
ARDLSGSPAYSGSWV

SEQ ID NO: 1032 - DNA, 45 bp, Artificial Sequence
  Description of Artificial Sequence: Synthetic heavy chain variable region CDR H3
gcgagagacttaagcggatctccagcatatagcggcagctgggtc

SEQ ID NO: 1033 - DNA, 324 bp, Artificial Sequence
  Description of Artificial Sequence: Synthetic light chain variable region
gaaacgacactcacgcagtctccagccaccctgtctgtgtctccaggggaaagagccaccctctcctgcagggccagtcagagtgttagcagcaacttagcctggtaccagcagaaacctggccaggctcccaggctcctcatctatgatgcatccaccagggccactggtatcccagacaggttcagtggcagtgggtctgggacagagttcactctcaccatcagcagcctgcagtctgaagactttgcactttattactgtcagcagtatgataggtggcctccgtggacgttcggccaagggaccaaggtggaaatcaaa

SEQ ID NO: 1034 - protein, 108 aa, Artificial Sequence
  Description of Artificial Sequence: Synthetic light chain variable region
ETTLTQSPATLSVSPGERATLSCRASQSVSSNLAWYQQKPGQAPRLLIYDASTRATGIPDRFSGSGSGTEFTLTISSLQSEDFALYYCQQYDRWPPWTFGQGTKVEIK

SEQ ID NO: 1035 - protein, 11 aa, Artificial Sequence
  Description of Artificial Sequence: Synthetic light chain variable region CDR L1
RASQSVSSNLA

SEQ ID NO: 1036 - DNA, 33 bp, Artificial Sequence
  Description of Artificial Sequence: Synthetic light chain variable region CDR L1
agggccagtcagagtgttagcagcaacttagcc

SEQ ID NO: 1037 - protein, 7 aa, Artificial Sequence
  Description of Artificial Sequence: Synthetic light chain variable region CDR L2
DASTRAT

SEQ ID NO: 1038 - DNA, 21 bp, Artificial Sequence
  Description of Artificial Sequence: Synthetic light chain variable region CDR L2
gatgcatccaccagggccact

SEQ ID NO: 1039 - protein, 10 aa, Artificial Sequence
  Description of Artificial Sequence: Synthetic light chain variable region CDR L3
QQYDRWPPWT

SEQ ID NO: 1040 - DNA, 30 bp, Artificial Sequence
  Description of Artificial Sequence: Synthetic light chain variable region CDR L3
cagcagtatgataggtggcctccgtggacg

SEQ ID NO: 1041 - DNA, 378 bp, Artificial Sequence
  Description of Artificial Sequence: Synthetic heavy chain variable region
caggtccagctggtgcagtctggggctgaggtgaagaagcctggggcctcagtgaaggtctcctgcaaggcttctggaaactccttcaacgacttttatatgcactgggtgcgacaggcccctggacaagggcttgagtggatgggatggatcgaccctaacaacggaggcgcaaactatgcacagaagtttcatggcagggtcactatgaccagggactcgtccatcaacacagcctacatggagttgagcaggctgagatccgacgacacggccgtctattactgtgcgagcgagccccccggcgttggttttggattgattccccactactactttgacaactggggccagggaaccctggtcaccgtctcctca

SEQ ID NO: 1042 - protein, 126 aa, Artificial Sequence
  Description of Artificial Sequence: Synthetic heavy chain variable region
QVQLVQSGAEVKKPGASVKVSCKASGNSFNDFYMHWVRQAPGQGLEWMGWIDPNNGGANYAQKFHGRVTMTRDSSINTAYMELSRLRSDDTAVYYCASEPPGVGFGLIPHYYFDNWGQGTLVTVSS

SEQ ID NO: 1043 - protein, 9 aa, Artificial Sequence
  Description of Artificial Sequence: Synthetic heavy chain variable region CDR H1
NSFNDFYMH

SEQ ID NO: 1044 - DNA, 27 bp, Artificial Sequence
  Description of Artificial Sequence: Synthetic heavy chain variable region CDR H1
aactccttcaacgacttttatatgcac

SEQ ID NO: 1045 - protein, 17 aa, Artificial Sequence
  Description of Artificial Sequence: Synthetic heavy chain variable region CDR H2
WIDPNNGGANYAQKFHG

SEQ ID NO: 1046 - DNA, 51 bp, Artificial Sequence
  Description of Artificial Sequence: Synthetic heavy chain variable region CDR H2
tggatcgaccctaacaacggaggcgcaaactatgcacagaagtttcatggc

SEQ ID NO: 1047 - protein, 19 aa, Artificial Sequence
  Description of Artificial Sequence: Synthetic heavy chain variable region CDR H3
ASEPPGVGFGLIPHYYFDN

SEQ ID NO: 1048 - DNA, 57 bp, Artificial Sequence
  Description of Artificial Sequence: Synthetic heavy chain variable region CDR H3
gcgagcgagccccccggcgttggttttggattgattccccactactactttgacaac

SEQ ID NO: 1049 - DNA, 339 bp, Artificial Sequence
  Description of Artificial Sequence: Synthetic light chain variable region
gaaattgtgatgacacagtctccagactccctggctgtgtctctgggcgagagggccaccatcaactgcaagtccagccagaatgttttagacacctccaacaataagaactacttagcttggtaccagcagaaaccaggacagcctcctagactgctcatttactgggcatctgcccgcggatccggggtccctgaccgattcagtggcagcgggtctgggacacatttcactctcaccatcagcagcctgcaggctgaagatgtggcagtttattactgtcagcaatattttagtattcctccgacgttcggccaagggaccaaggtggagatcaaa

SEQ ID NO: 1050 - protein, 113 aa, Artificial Sequence
  Description of Artificial Sequence: Synthetic light chain variable region
EIVMTQSPDSLAVSLGERATINCKSSQNVLDTSNNKNYLAWYQQKPGQPPRLLIYWASARGSGVPDRFSGSGSGTHFTLTISSLQAEDVAVYYCQQYFSIPPTFGQGTKVEIK

SEQ ID NO: 1051 - protein, 17 aa, Artificial Sequence
  Description of Artificial Sequence: Synthetic light chain variable region CDR L1
KSSQNVLDTSNNKNYLA

SEQ ID NO: 1052 - DNA, 51 bp, Artificial Sequence
  Description of Artificial Sequence: Synthetic light chain variable region CDR L1
aagtccagccagaatgttttagacacctccaacaataagaactacttagct

SEQ ID NO: 1053 - protein, 7 aa, Artificial Sequence
  Description of Artificial Sequence: Synthetic light chain variable region CDR L2
WASARGS

SEQ ID NO: 1054 - DNA, 21 bp, Artificial Sequence
  Description of Artificial Sequence: Synthetic light chain variable region CDR L2
tgggcatctgcccgcggatcc

SEQ ID NO: 1055 - protein, 9 aa, Artificial Sequence
  Description of Artificial Sequence: Synthetic light chain variable region CDR L3
QQYFSIPPT

SEQ ID NO: 1056 - DNA, 27 bp, Artificial Sequence
  Description of Artificial Sequence: Synthetic light chain variable region CDR L3
cagcaatattttagtattcctccgacg

SEQ ID NO: 1057 - DNA, 378 bp, Artificial Sequence
  Description of Artificial Sequence: Synthetic heavy chain variable region
caggtccagctggtgcagtctggggctgaggtgaagaagcctgggtcctcggtgaaggtctcctgcaaggttgccggaggctccttctccaattatgcaatcgcctggctgcgacaggcccctggacaagggcttgagtggatgggaggtatcatccctgcctttaacagagcaatgtatgcacggaagttccaagacagagtcacaattaccgcgtacgcatcaacgaccactgcctacctggacattaccggcctcagatctgaggacacggccctttattattgtgcgaggcctgctggagactttggggatttaaagtgggtacgatcgccttttgactactggggccagggaaccctgatcaccgtctcctca

SEQ ID NO: 1058 - protein, 126 aa, Artificial Sequence
  Description of Artificial Sequence: Synthetic heavy chain variable region
QVQLVQSGAEVKKPGSSVKVSCKVAGGSFSNYAIAWLRQAPGQGLEWMGGIIPAFNRAMYARKFQDRVTITAYASTTTAYLDITGLRSEDTALYYCARPAGDFGDLKWVRSPFDYWGQGTLITVSS

SEQ ID NO: 1059 - protein, 9 aa, Artificial Sequence
  Description of Artificial Sequence: Synthetic heavy chain variable region CDR H1
GSFSNYAIA

SEQ ID NO: 1060 - DNA, 27 bp, Artificial Sequence
  Description of Artificial Sequence: Synthetic heavy chain variable region CDR H1
ggctccttctccaattatgcaatcgcc

SEQ ID NO: 1061 - protein, 17 aa, Artificial Sequence
  Description of Artificial Sequence: Synthetic heavy chain variable region CDR H2
GIIPAFNRAMYARKFQD

SEQ ID NO: 1062 - DNA, 51 bp, Artificial Sequence
  Description of Artificial Sequence: Synthetic heavy chain variable region CDR H2
ggtatcatccctgcctttaacagagcaatgtatgcacggaagttccaagac

SEQ ID NO: 1063 - protein, 19 aa, Artificial Sequence
  Description of Artificial Sequence: Synthetic heavy chain variable region CDR H3
ARPAGDFGDLKWVRSPFDY

SEQ ID NO: 1064 - DNA, 57 bp, Artificial Sequence
  Description of Artificial Sequence: Synthetic heavy chain variable region CDR H3
gcgaggcctgctggagactttggggatttaaagtgggtacgatcgccttttgactac

SEQ ID NO: 1065 - DNA, 327 bp, Artificial Sequence
  Description of Artificial Sequence: Synthetic light chain variable region
gatattgtgatgacgcagactccaggcaccctgtctgtgtctccaggggaaagagccaccctctcctgcagggccagtcaggacgttggcatcaacttagcctggtatcagcagaagcctggccaggctcccaggctcctcatatatggtgcatccaccagggccactgatgtcccagccaagttcagtggcagtgggtctgggacagacttcactctcaccatcagcagcctgcagtctgaagattttggagtttattattgtcaggagtataatgactggcctccccagctctctttcggccctgggaccaaagtggatatcaaa

SEQ ID NO: 1066 - protein, 109 aa, Artificial Sequence
  Description of Artificial Sequence: Synthetic light chain variable region
DIVMTQTPGTLSVSPGERATLSCRASQDVGINLAWYQQKPGQAPRLLIYGASTRATDVPAKFSGSGSGTDFTLTISSLQSEDFGVYYCQEYNDWPPQLSFGPGTKVDIK

SEQ ID NO: 1067 - protein, 11 aa, Artificial Sequence
  Description of Artificial Sequence: Synthetic light chain variable region CDR L1
RASQDVGINLA

SEQ ID NO: 1068 - DNA, 33 bp, Artificial Sequence
  Description of Artificial Sequence: Synthetic light chain variable region CDR L1
agggccagtcaggacgttggcatcaacttagcc

SEQ ID NO: 1069 - protein, 7 aa, Artificial Sequence
  Description of Artificial Sequence: Synthetic light chain variable region CDR L2
GASTRAT

SEQ ID NO: 1070 - DNA, 21 bp, Artificial Sequence
  Description of Artificial Sequence: Synthetic light chain variable region CDR L2
ggtgcatccaccagggccact

SEQ ID NO: 1071 - protein, 11 aa, Artificial Sequence
  Description of Artificial Sequence: Synthetic light chain variable region CDR L3
QEYNDWPPQLS

SEQ ID NO: 1072 - DNA, 33 bp, Artificial Sequence
  Description of Artificial Sequence: Synthetic light chain variable region CDR L3
caggagtataatgactggcctccccagctctct

SEQ ID NO: 1073 - DNA, 378 bp, Artificial Sequence
  Description of Artificial Sequence: Synthetic heavy chain variable region
cagatcaccttgaaggagtctggtcctacgctggtgaaacccacacagaccctcacactgacctgcaccctctctgggttctcactcagcactcctagaatgggtgtgggctggatccgtcagcccccaggaaaggccctggagtggcttgcactcattgattgggatgatgataggcgctacagtccatctctgaagaccaggctcaccatcaccaaggacacttccaaaaatcaggtggtccttagaatgaccgacatggaccctgtggacacaggcacatattactgtgtacacagcgatgtctatactactggtggttattacttgtactactttgactactggggccagggaaccctggtcaccgtctcctca

SEQ ID NO: 1074 - protein, 126 aa, Artificial Sequence
  Description of Artificial Sequence: Synthetic heavy chain variable region
QITLKESGPTLVKPTQTLTLTCTLSGFSLSTPRMGVGWIRQPPGKALEWLALIDWDDDRRYSPSLKTRLTITKDTSKNQVVLRMTDMDPVDTGTYYCVHSDVYTTGGYYLYYFDYWGQGTLVTVSS

SEQ ID NO: 1075 - protein, 11 aa, Artificial Sequence
  Description of Artificial Sequence: Synthetic heavy chain variable region CDR H1
FSLSTPRMGVG

SEQ ID NO: 1076 - DNA, 33 bp, Artificial Sequence
  Description of Artificial Sequence: Synthetic heavy chain variable region CDR H1
ttctcactcagcactcctagaatgggtgtgggc

SEQ ID NO: 1077 - protein, 16 aa, Artificial Sequence
  Description of Artificial Sequence: Synthetic heavy chain variable region CDR H2
LIDWDDDRRYSPSLKT

SEQ ID NO: 1078 - DNA, 48 bp, Artificial Sequence
  Description of Artificial Sequence: Synthetic heavy chain variable region CDR H2
ctcattgattgggatgatgataggcgctacagtccatctctgaagacc

SEQ ID NO: 1079 - protein, 18 aa, Artificial Sequence
  Description of Artificial Sequence: Synthetic heavy chain variable region CDR H3
VHSDVYTTGGYYLYYFDY

SEQ ID NO: 1080 - DNA, 54 bp, Artificial Sequence
  Description of Artificial Sequence: Synthetic heavy chain variable region CDR H3
gtacacagcgatgtctatactactggtggttattacttgtactactttgactac

SEQ ID NO: 1081 - DNA, 321 bp, Artificial Sequence
  Description of Artificial Sequence: Synthetic light chain variable region
gacatccaggtgacccagtctccatcctccctgtctgcatctgtaggagacagagtcaccatcacttgccgggcaagtcagaccattcccagctatttaaattggtatcagcacaaaccagggaaagcccctcagctcctgatctatgctgcatccaatttgcgaagtggggtcccaccgaggttccgtggcagtggatctgggacagatttcactctcaccgtcagcagtctgcaacctgaagattttgcaacttacttctgtcaacagagttacagtagcccatacacttttggccaggggaccaagctggagatcaaa

SEQ ID NO: 1082 - protein, 107 aa, Artificial Sequence
  Description of Artificial Sequence: Synthetic light chain variable region
DIQVTQSPSSLSASVGDRVTITCRASQTIPSYLNWYQHKPGKAPQLLIYAASNLRSGVPPRFRGSGSGTDFTLTVSSLQPEDFATYFCQQSYSSPYTFGQGTKLEIK

SEQ ID NO: 1083 - protein, 11 aa, Artificial Sequence
  Description of Artificial Sequence: Synthetic light chain variable region CDR L1
RASQTIPSYLN

SEQ ID NO: 1084 - DNA, 33 bp, Artificial Sequence
  Description of Artificial Sequence: Synthetic light chain variable region CDR L1
cgggcaagtcagaccattcccagctatttaaat

SEQ ID NO: 1085 - protein, 7 aa, Artificial Sequence
  Description of Artificial Sequence: Synthetic light chain variable region CDR L2
AASNLRS

SEQ ID NO: 1086 - DNA, 21 bp, Artificial Sequence
  Description of Artificial Sequence: Synthetic light chain variable region CDR L2
gctgcatccaatttgcgaagt

SEQ ID NO: 1087 - protein, 9 aa, Artificial Sequence
  Description of Artificial Sequence: Synthetic light chain variable region CDR L3
QQSYSSPYT

SEQ ID NO: 1088 - DNA, 27 bp, Artificial Sequence
  Description of Artificial Sequence: Synthetic light chain variable region CDR L3
caacagagttacagtagcccatacact

SEQ ID NO: 1089 - DNA, 357 bp, Artificial Sequence
  Description of Artificial Sequence: Synthetic heavy chain variable region
caggtccagctggtacagtctggaactgaggtgaagaagcctggggcctcagtgaaggtctcctgcaagggctctggttacatgtttgcaaattttggtgtcagctgggtgcgacaggcccctggacgagggcttgagtggatcggatggatcagcgcttacaatggaaacacatactatggacgtgagcagggcagattcaccatgaccacagacacgaacacagcctacctggagctgacgagtctcagatatgacgacacggccctttatttctgtgcgagagattcgggagcgacggcggctggaatactctgggactattggggccagggaaccctggtcaccgtctcctca

SEQ ID NO: 1090 - protein, 119 aa, Artificial Sequence
  Description of Artificial Sequence: Synthetic heavy chain variable region
QVQLVQSGTEVKKPGASVKVSCKGSGYMFANFGVSWVRQAPGRGLEWIGWISAYNGNTYYGREQGRFTMTTDTNTAYLELTSLRYDDTALYFCARDSGATAAGILWDYWGQGTLVTVSS

SEQ ID NO: 1091 - protein, 9 aa, Artificial Sequence
  Description of Artificial Sequence: Synthetic heavy chain variable region CDR H1
YMFANFGVS

SEQ ID NO: 1092 - DNA, 27 bp, Artificial Sequence
  Description of Artificial Sequence: Synthetic heavy chain variable region CDR H1
tacatgtttgcaaattttggtgtcagc

SEQ ID NO: 1093 - protein, 16 aa, Artificial Sequence
  Description of Artificial Sequence: Synthetic heavy chain variable region CDR H2
WISAYNGNTYYGREQG

SEQ ID NO: 1094 - DNA, 48 bp, Artificial Sequence
  Description of Artificial Sequence: Synthetic heavy chain variable region CDR H2
tggatcagcgcttacaatggaaacacatactatggacgtgagcagggc

SEQ ID NO: 1095 - protein, 15 aa, Artificial Sequence
  Description of Artificial Sequence: Synthetic heavy chain variable region CDR H3
ARDSGATAAGILWDY

SEQ ID NO: 1096 - DNA, 45 bp, Artificial Sequence
  Description of Artificial Sequence: Synthetic heavy chain variable region CDR H3
gcgagagattcgggagcgacggcggctggaatactctgggactat

SEQ ID NO: 1097 - DNA, 336 bp, Artificial Sequence
  Description of Artificial Sequence: Synthetic light chain variable region
gaaattgtaatgacacagtctccactctccctgcccgtcacccttggacagccggcctccatctcctgcaggtctagtcaaagcctcgcatacactgatggaagcacttacttgaattggtttcaccagaggccaggccagtctccacggcgcctaatttataaggtttttaaccgggactctggggtccccgacagattcagcggcagtggggcaggcactgatttcacactgactatcagcagggtggaggctgaggatgttggggtttattactgcatgcaagctacacactggcctcggacgttcggccaggggaccaaagtggatatcaaa

SEQ ID NO: 1098 - protein, 112 aa, Artificial Sequence
  Description of Artificial Sequence: Synthetic light chain variable region
EIVMTQSPLSLPVTLGQPASISCRSSQSLAYTDGSTYLNWFHQRPGQSPRRLIYKVFNRDSGVPDRFSGSGAGTDFTLTISRVEAEDVGVYYCMQATHWPRTFGQGTKVDIK

SEQ ID NO: 1099 - protein, 16 aa, Artificial Sequence
  Description of Artificial Sequence: Synthetic light chain variable region CDR L1
RSSQSLAYTDGSTYLN

SEQ ID NO: 1100 - DNA, 48 bp, Artificial Sequence
  Description of Artificial Sequence: Synthetic light chain variable region CDR L1
aggtctagtcaaagcctcgcatacactgatggaagcacttacttgaat

SEQ ID NO: 1101 - protein, 7 aa, Artificial Sequence
  Description of Artificial Sequence: Synthetic light chain variable region CDR L2
KVFNRDS

SEQ ID NO: 1102 - DNA, 21 bp, Artificial Sequence
  Description of Artificial Sequence: Synthetic light chain variable region CDR L2
aaggtttttaaccgggactct

SEQ ID NO: 1103 - protein, 9 aa, Artificial Sequence
  Description of Artificial Sequence: Synthetic light chain variable region CDR L3
MQATHWPRT

SEQ ID NO: 1104 - DNA, 27 bp, Artificial Sequence
  Description of Artificial Sequence: Synthetic light chain variable region CDR L3
atgcaagctacacactggcctcggacg

SEQ ID NO: 1105 - DNA, 357 bp, Artificial Sequence
  Description of Artificial Sequence: Synthetic heavy chain variable region
caggtccagctggtacagtctggaagtgaggtgaagaagcctggggcctcggtgacgctctcctgcaaggcctcaggttacaggttttccaactatggtgtcagctgggtgcgacaggcccccggacaaggcctagagtggatgggatggatcagcggttacaatggaaacataaagtatggaaacagtctccagggcagagtcaccctgaccacagacacgaccacggcctacatggaggtgacgagcctaacatctgacgacacggccgtgtattactgtgcgagagatgtcccagctgacggggtccacttcatggacgtctggggcaaagggaccacggtcaccgtctcctca

SEQ ID NO: 1106 - protein, 119 aa, Artificial Sequence
  Description of Artificial Sequence: Synthetic heavy chain variable region
QVQLVQSGSEVKKPGASVTLSCKASGYRFSNYGVSWVRQAPGQGLEWMGWISGYNGNIKYGNSLQGRVTLTTDTTTAYMEVTSLTSDDTAVYYCARDVPADGVHFMDVWGKGTTVTVSS

SEQ ID NO: 1107 - protein, 9 aa, Artificial Sequence
  Description of Artificial Sequence: Synthetic heavy chain variable region CDR H1
YRFSNYGVS

SEQ ID NO: 1108 - DNA, 27 bp, Artificial Sequence
  Description of Artificial Sequence: Synthetic heavy chain variable region CDR H1
tacaggttttccaactatggtgtcagc

SEQ ID NO: 1109 - protein, 17 aa, Artificial Sequence
  Description of Artificial Sequence: Synthetic heavy chain variable region CDR H2
WISGYNGNIKYGNSLQG

SEQ ID NO: 1110 - DNA, 51 bp, Artificial Sequence
  Description of Artificial Sequence: Synthetic heavy chain variable region CDR H2
tggatcagcggttacaatggaaacataaagtatggaaacagtctccagggc

SEQ ID NO: 1111 - protein, 14 aa, Artificial Sequence
  Description of Artificial Sequence: Synthetic heavy chain variable region CDR H3
ARDVPADGVHFMDV

SEQ ID NO: 1112 - DNA, 42 bp, Artificial Sequence; identical to SEQ ID NO: 72
  Description of Artificial Sequence: Synthetic heavy chain variable region CDR H3

SEQ ID NO: 1113 - DNA, 336 bp, Artificial Sequence
  Description of Artificial Sequence: Synthetic light chain variable region
gaaattgtattgacgcagtctccactctccctgcccgtcacccttggacagccggcctccatctcctgcaggtctagtcaaagcctcgtccacagtgatactaacacctacttgacctggtttcagcagaggccaggccaatctccacggcgcctaatttataaggtttctcaccgggactctggggtcccagacagattcagcggcagtgggtcaggcacaactttcacgctgaaaatcgccagggtggaggctgaggatgttgggatttattactgcatggaggggtcacactgggctccgactttcggccaggggaccaaagtggatatcaaa

SEQ ID NO: 1114 - protein, 112 aa, Artificial Sequence
  Description of Artificial Sequence: Synthetic light chain variable region
EIVLTQSPLSLPVTLGQPASISCRSSQSLVHSDTNTYLTWFQQRPGQSPRRLIYKVSHRDSGVPDRFSGSGSGTTFTLKIARVEAEDVGIYYCMEGSHWAPTFGQGTKVDIK

SEQ ID NO: 1115 - protein, 16 aa, Artificial Sequence
  Description of Artificial Sequence: Synthetic light chain variable region CDR L1
RSSQSLVHSDTNTYLT

SEQ ID NO: 1116 - DNA, 48 bp, Artificial Sequence
  Description of Artificial Sequence: Synthetic light chain variable region CDR L1
aggtctagtcaaagcctcgtccacagtgatactaacacctacttgacc

SEQ ID NO: 1117 - protein, 7 aa, Artificial Sequence
  Description of Artificial Sequence: Synthetic light chain variable region CDR L2
KVSHRDS

SEQ ID NO: 1118 - DNA, 21 bp, Artificial Sequence
  Description of Artificial Sequence: Synthetic light chain variable region CDR L2
aaggtttctcaccgggactct

SEQ ID NO: 1119 - protein, 9 aa, Artificial Sequence
  Description of Artificial Sequence: Synthetic light chain variable region CDR L3
MEGSHWAPT

SEQ ID NO: 1120 - DNA, 27 bp, Artificial Sequence
  Description of Artificial Sequence: Synthetic light chain variable region CDR L3
atggaggggtcacactgggctccgact

SEQ ID NO: 1121 - DNA, 384 bp, Artificial Sequence
  Description of Artificial Sequence: Synthetic heavy chain variable region
caggtgcagctacagcagtggggggccgaggtgaagaagcctgggtcatcggtgaaggtctcctgcaaggcttctggagtcgccttgagcagcgttgcaatcagctgggtgcgacaggcccctggacaagggcttgagtggatgggagggatcctccctgggtttgacaaggtcagatttgcccaggagtttgagaatagagccactctaaccgcggacacagctagggatatagcctacatggagttgagcggactgagatctgacgacacggccgtctactactgtgcgataatcgacccccaagattgcactagtgccagctgcttttgggtcaactggctcgacccctggggccagggaaccctggtcaccgtctcctca

SEQ ID NO: 1122 - protein, 128 aa, Artificial Sequence
  Description of Artificial Sequence: Synthetic heavy chain variable region
QVQLQQWGAEVKKPGSSVKVSCKASGVALSSVAISWVRQAPGQGLEWMGGILPGFDKVRFAQEFENRATLTADTARDIAYMELSGLRSDDTAVYYCAIIDPQDCTSASCFWVNWLDPWGQGTLVTVSS

SEQ ID NO: 1123 - protein, 9 aa, Artificial Sequence
  Description of Artificial Sequence: Synthetic heavy chain variable region CDR H1
VALSSVAIS

SEQ ID NO: 1124 - DNA, 27 bp, Artificial Sequence
  Description of Artificial Sequence: Synthetic heavy chain variable region CDR H1
gtcgccttgagcagcgttgcaatcagc

SEQ ID NO: 1125 - protein, 17 aa, Artificial Sequence
  Description of Artificial Sequence: Synthetic heavy chain variable region CDR H2
GILPGFDKVRFAQEFEN

SEQ ID NO: 1126 - DNA, 51 bp, Artificial Sequence
  Description of Artificial Sequence: Synthetic heavy chain variable region CDR H2
gggatcctccctgggtttgacaaggtcagatttgcccaggagtttgagaat

SEQ ID NO: 1127 - protein, 21 aa, Artificial Sequence
  Description of Artificial Sequence: Synthetic heavy chain variable region CDR H3
AIIDPQDCTSASCFWVNWLDP

SEQ ID NO: 1128 - DNA, 63 bp, Artificial Sequence
  Description of Artificial Sequence: Synthetic heavy chain variable region CDR H3
gcgataatcgacccccaagattgcactagtgccagctgcttttgggtcaactggctcgacccc

SEQ ID NO: 1129 - DNA, 324 bp, Artificial Sequence
  Description of Artificial Sequence: Synthetic light chain variable region
gaaacgacactcacgcagtctccaggcaccctgaccgtgtctccaggggagagagccaccctctcctgcagggccagtcagagtattattagaaacaacctagcctggtaccagcagaaacctggccaggctcccaggctcctcatctatgctgcatccaatagggccactgacatcccagacaggttcagtggcagtgggtctgggacagacttcactctcaccatcagcagactggaagcacaagattttgcagtgtatttctgtcagcagtatggtacctctccgatcaccttcggccaagggaccaaggtggaaatcaaa

SEQ ID NO: 1130 - protein, 108 aa, Artificial Sequence
  Description of Artificial Sequence: Synthetic light chain variable region
ETTLTQSPGTLTVSPGERATLSCRASQSIIRNNLAWYQQKPGQAPRLLIYAASNRATDIPDRFSGSGSGTDFTLTISRLEAQDFAVYFCQQYGTSPITFGQGTKVEIK

SEQ ID NO: 1131 - protein, 12 aa, Artificial Sequence
  Description of Artificial Sequence: Synthetic light chain variable region CDR L1
RASQSIIRNNLA

SEQ ID NO: 1132 - DNA, 36 bp, Artificial Sequence
  Description of Artificial Sequence: Synthetic light chain variable region CDR L1
agggccagtcagagtattattagaaacaacctagcc

SEQ ID NO: 1133 - protein, 7 aa, Artificial Sequence
  Description of Artificial Sequence: Synthetic light chain variable region CDR L2
AASNRAT

SEQ ID NO: 1134 - DNA, 21 bp, Artificial Sequence
  Description of Artificial Sequence: Synthetic light chain variable region CDR L2
gctgcatccaatagggccact

SEQ ID NO: 1135 - protein, 9 aa, Artificial Sequence
  Description of Artificial Sequence: Synthetic light chain variable region CDR L3
QQYGTSPIT

SEQ ID NO: 1136 - DNA, 27 bp, Artificial Sequence
  Description of Artificial Sequence: Synthetic light chain variable region CDR L3
cagcagtatggtacctctccgatcacc

SEQ ID NO: 1137 - DNA, 378 bp, Artificial Sequence
  Description of Artificial Sequence: Synthetic heavy chain variable region
gaggtgcagctgttggagtctggggctgaggtgaagaagcctgggtcctcggtgaaggtctcctgcaaggttgccggaggaaccttcagcgactacgccatcagctgggtgcgacaggcccctggtcaagggctggagtacttgggagggatcattcctgcctttaaaagagcaatgtatccacggaagtttcaagacagagtcaccattaccgcggacgagtccacgagcactgcctacatggagctgagaggcctgagatctgaagacacggccctgtattattgtgcgagacctgctggagactttggcgatttaaagtggctacgatcgccttttgactactggggccagggaaccctggtcaccgtctcctca

SEQ ID NO: 1138 - protein, 126 aa, Artificial Sequence
  Description of Artificial Sequence: Synthetic heavy chain variable region
EVQLLESGAEVKKPGSSVKVSCKVAGGTFSDYAISWVRQAPGQGLEYLGGIIPAFKRAMYPRKFQDRVTITADESTSTAYMELRGLRSEDTALYYCARPAGDFGDLKWLRSPFDYWGQGTLVTVSS

SEQ ID NO: 1139 - protein, 9 aa, Artificial Sequence
  Description of Artificial Sequence: Synthetic heavy chain variable region CDR H1
GTFSDYAIS

SEQ ID NO: 1140 - DNA, 27 bp, Artificial Sequence
  Description of Artificial Sequence: Synthetic heavy chain variable region CDR H1
ggaaccttcagcgactacgccatcagc

SEQ ID NO: 1141 - protein, 17 aa, Artificial Sequence
  Description of Artificial Sequence: Synthetic heavy chain variable region CDR H2
GIIPAFKRAMYPRKFQD

SEQ ID NO: 1142 - DNA, 51 bp, Artificial Sequence
  Description of Artificial Sequence: Synthetic heavy chain variable region CDR H2
gggatcattcctgcctttaaaagagcaatgtatccacggaagtttcaagac

SEQ ID NO: 1143 - protein, 19 aa, Artificial Sequence
  Description of Artificial Sequence: Synthetic heavy chain variable region CDR H3
ARPAGDFGDLKWLRSPFDY

SEQ ID NO: 1144 - DNA, 57 bp, Artificial Sequence
  Description of Artificial Sequence: Synthetic heavy chain variable region CDR H3
gcgagacctgctggagactttggcgatttaaagtggctacgatcgccttttgactac

SEQ ID NO: 1145 - DNA, 327 bp, Artificial Sequence
  Description of Artificial Sequence: Synthetic light chain variable region
gatattgtgctgactcagtctccagccaccctgtctgtgtctccaggggaaagagccacgctctcctgcagggccagtgagggtgtaggcatcaacttagcctggtaccagcagaaacctggccaggctcccaggctcctcatctatggtgcatcgaccagggccactgatatcccagccaggttcagtggcagtgggtctgggacagacttcactctcaccatcagcagcctgcaatctgaagattttgcagtttattattgtcagcagtataatgattggcctccccagctcactttcggccctgggaccaaagtggatatcaaa

SEQ ID NO: 1146 - protein, 109 aa, Artificial Sequence
  Description of Artificial Sequence: Synthetic light chain variable region
DIVLTQSPATLSVSPGERATLSCRASEGVGINLAWYQQKPGQAPRLLIYGASTRATDIPARFSGSGSGTDFTLTISSLQSEDFAVYYCQQYNDWPPQLTFGPGTKVDIK

SEQ ID NO: 1147 - protein, 11 aa, Artificial Sequence
  Description of Artificial Sequence: Synthetic light chain variable region CDR L1
RASEGVGINLA

SEQ ID NO: 1148 - DNA, 33 bp, Artificial Sequence
  Description of Artificial Sequence: Synthetic light chain variable region CDR L1
agggccagtgagggtgtaggcatcaacttagcc

SEQ ID NO: 1149 - protein, 7 aa, Artificial Sequence
  Description of Artificial Sequence: Synthetic light chain variable region CDR L2
GASTRAT

SEQ ID NO: 1150 - DNA, 21 bp, Artificial Sequence
  Description of Artificial Sequence: Synthetic light chain variable region CDR L2
ggtgcatcgaccagggccact

SEQ ID NO: 1151 - protein, 11 aa, Artificial Sequence
  Description of Artificial Sequence: Synthetic light chain variable region CDR L3
QQYNDWPPQLT

SEQ ID NO: 1152 - DNA, 33 bp, Artificial Sequence
  Description of Artificial Sequence: Synthetic light chain variable region CDR L3
cagcagtataatgattggcctccccagctcact

SEQ ID NO: 1153 - DNA, 378 bp, Artificial Sequence
  Description of Artificial Sequence: Synthetic heavy chain variable region
gaggtgcagctggtggagtctggggctgaggtgaagaagcctgggtcctcggtgaaggtctcctgtaaggttgtcggaggcagtttcagcaactatggtatcagctgggtgcgacaggcccctggacaggggcctgagtggatgggcgggatcatccctgcctttaagacagcaaaatatgcaaagaagttcgaggacagagtcacaattaccgcggacgaatccacgagcactgcctacatggaggtgagcggcctgagatctgacgacacggccctgtattattgtgcgaggcctgaacgagactttgggcatttaaagtggctacgctcgccttttgactactggggccagggaaccctggtcaccgtctcctca

SEQ ID NO: 1154 - protein, 126 aa, Artificial Sequence
  Description of Artificial Sequence: Synthetic heavy chain variable region
EVQLVESGAEVKKPGSSVKVSCKVVGGSFSNYGISWVRQAPGQGPEWMGGIIPAFKTAKYAKKFEDRVTITADESTSTAYMEVSGLRSDDTALYYCARPERDFGHLKWLRSPFDYWGQGTLVTVSS

SEQ ID NO: 1155 - protein, 9 aa, Artificial Sequence
  Description of Artificial Sequence: Synthetic heavy chain variable region CDR H1
GSFSNYGIS

SEQ ID NO: 1156 - DNA, 27 bp, Artificial Sequence
  Description of Artificial Sequence: Synthetic heavy chain variable region CDR H1
ggcagtttcagcaactatggtatcagc

SEQ ID NO: 1157 - protein, 17 aa, Artificial Sequence
  Description of Artificial Sequence: Synthetic heavy chain variable region CDR H2
GIIPAFKTAKYAKKFED

SEQ ID NO: 1158 - DNA, 51 bp, Artificial Sequence
  Description of Artificial Sequence: Synthetic heavy chain variable region CDR H2
gggatcatccctgcctttaagacagcaaaatatgcaaagaagttcgaggac

SEQ ID NO: 1159 - protein, 19 aa, Artificial Sequence
  Description of Artificial Sequence: Synthetic heavy chain variable region CDR H3
ARPERDFGHLKWLRSPFDY

SEQ ID NO: 1160 - DNA, 57 bp, Artificial Sequence
  Description of Artificial Sequence: Synthetic heavy chain variable region CDR H3
gcgaggcctgaacgagactttgggcatttaaagtggctacgctcgccttttgactac

SEQ ID NO: 1161 - DNA, 327 bp, Artificial Sequence
  Description of Artificial Sequence: Synthetic light chain variable region
gaaacgacactcacgcagtctccagccaccctgtctgtgtctccaggggaaagagtcaccctctcctgcagggccagtcagggtgttagcatcaacttagcctggtaccagcagaaacctggccaggctcccaggctcctcatctatggtgcatccaccagggccactgatatcccagccaggttcagtggcagtgggtctgggacagacttcactctcaccatcagcagcctgcagtctgaagattttgcagtttattattgtcagcagtataatgactggcctccccagctcactttcggccctgggaccaaggtggaaatcaaa

SEQ ID NO: 1162 - protein, 109 aa, Artificial Sequence
  Description of Artificial Sequence: Synthetic light chain variable region
ETTLTQSPATLSVSPGERVTLSCRASQGVSINLAWYQQKPGQAPRLLIYGASTRATDIPARFSGSGSGTDFTLTISSLQSEDFAVYYCQQYNDWPPQLTFGPGTKVEIK

SEQ ID NO: 1163 - protein, 11 aa, Artificial Sequence
  Description of Artificial Sequence: Synthetic light chain variable region CDR L1
RASQGVSINLA

SEQ ID NO: 1164 - DNA, 33 bp, Artificial Sequence
  Description of Artificial Sequence: Synthetic light chain variable region CDR L1
agggccagtcagggtgttagcatcaacttagcc

SEQ ID NO: 1165 - protein, 7 aa, Artificial Sequence
  Description of Artificial Sequence: Synthetic light chain variable region CDR L2
GASTRAT

SEQ ID NO: 1166 - DNA, 21 bp, Artificial Sequence
  Description of Artificial Sequence: Synthetic light chain variable region CDR L2
ggtgcatccaccagggccact

SEQ ID NO: 1167 - protein, 11 aa, Artificial Sequence
  Description of Artificial Sequence: Synthetic light chain variable region CDR L3
QQYNDWPPQLT

SEQ ID NO: 1168 - DNA, 33 bp, Artificial Sequence
  Description of Artificial Sequence: Synthetic light chain variable region CDR L3
cagcagtataatgactggcctccccagctcact

SEQ ID NO: 1169 - DNA, 384 bp, Artificial Sequence
  Description of Artificial Sequence: Synthetic heavy chain variable region
caggtccagctggtgcagtctgggtctgaggtgaagaggcctgggtcatcggtgaaggtctcctgcaaggcctcaggagtcgctttgaccaccgttgctgtcaactgggtgcgccaggtccctgggcaagggcctgagtggattggagggatcctcattgggtttggtaaggtcagacaggcccagaaatttgagaaccgagtcacttttaccgcggacgcatctaggaacacagcctacatggagttgagcggactgagatctgaggacacggccgtctattactgtgcgataatcgacccccaagattgtactcgtgccagttgcttttgggtcaactggctcgccccctggggccacggaaccctggtcaccgtctcctca

SEQ ID NO: 1170 - protein, 128 aa, Artificial Sequence
  Description of Artificial Sequence: Synthetic heavy chain variable region
QVQLVQSGSEVKRPGSSVKVSCKASGVALTTVAVNWVRQVPGQGPEWIGGILIGFGKVRQAQKFENRVTFTADASRNTAYMELSGLRSEDTAVYYCAIIDPQDCTRASCFWVNWLAPWGHGTLVTVSS

SEQ ID NO: 1171 - protein, 9 aa, Artificial Sequence
  Description of Artificial Sequence: Synthetic heavy chain variable region CDR H1
VALTTVAVN

SEQ ID NO: 1172 - DNA, 27 bp, Artificial Sequence
  Description of Artificial Sequence: Synthetic heavy chain variable region CDR H1
gtcgctttgaccaccgttgctgtcaac

SEQ ID NO: 1173 - protein, 17 aa, Artificial Sequence
  Description of Artificial Sequence: Synthetic heavy chain variable region CDR H2
GILIGFGKVRQAQKFEN

SEQ ID NO: 1174 - DNA, 51 bp, Artificial Sequence
  Description of Artificial Sequence: Synthetic heavy chain variable region CDR H2
gggatcctcattgggtttggtaaggtcagacaggcccagaaatttgagaac

SEQ ID NO: 1175 - protein, 21 aa, Artificial Sequence
  Description of Artificial Sequence: Synthetic heavy chain variable region CDR H3
AIIDPQDCTRASCFWVNWLAP

SEQ ID NO: 1176 - DNA, 63 bp, Artificial Sequence
  Description of Artificial Sequence: Synthetic heavy chain variable region CDR H3
gcgataatcgacccccaagattgtactcgtgccagttgcttttgggtcaactggctcgccccc

SEQ ID NO: 1177 - DNA, 324 bp, Artificial Sequence
  Description of Artificial Sequence: Synthetic light chain variable region
gacatccgggtgacccagtctccaggcaccctgaccttgtccccaggggagagagcctccctctcctgcagggccagtgagagtattcttaacgggaacttagcctggtaccaacagaaacctggccaggctcccaggctcctcatctatgctgcttccagtagggccactgacatcccagacaggttcagtggcagtgggtctgggacagacttcactctcaccatcagcagactggagcctcaagattttgcagtctattattgtcagcagtatggttcggctccgatcaccttcggccaagggacacgactggagattaaa

SEQ ID NO: 1178 - protein, 108 aa, Artificial Sequence
  Description of Artificial Sequence: Synthetic light chain variable region
DIRVTQSPGTLTLSPGERASLSCRASESILNGNLAWYQQKPGQAPRLLIYAASSRATDIPDRFSGSGSGTDFTLTISRLEPQDFAVYYCQQYGSAPITFGQGTRLEIK

SEQ ID NO: 1179 - protein, 12 aa, Artificial Sequence
  Description of Artificial Sequence: Synthetic light chain variable region CDR L1
RASESILNGNLA

SEQ ID NO: 1180 - DNA, 36 bp, Artificial Sequence
  Description of Artificial Sequence: Synthetic light chain variable region CDR L1
agggccagtgagagtattcttaacgggaacttagcc

SEQ ID NO: 1181 - protein, 7 aa, Artificial Sequence
  Description of Artificial Sequence: Synthetic light chain variable region CDR L2
AASSRAT

SEQ ID NO: 1182 - DNA, 21 bp, Artificial Sequence
  Description of Artificial Sequence: Synthetic light chain variable region CDR L2
gctgcttccagtagggccact

SEQ ID NO: 1183 - protein, 9 aa, Artificial Sequence
  Description of Artificial Sequence: Synthetic light chain variable region CDR L3
QQYGSAPIT

SEQ ID NO: 1184 - DNA, 27 bp, Artificial Sequence
  Description of Artificial Sequence: Synthetic light chain variable region CDR L3
cagcagtatggttcggctccgatcacc

SEQ ID NO: 1185 - DNA, 357 bp, Artificial Sequence
  Description of Artificial Sequence: Synthetic heavy chain variable region
caggtccagcttgtacagtctggaagtgaggtgaagaagcctggggcctcggtgacggtctcctgcaaggcctcaggttacaggttttccaactatggtgtcagctgggtgcgacaggcccctggacaaggcctagagtggatgggatggatcagcgcttacaatggaaacacaaagtatggaaatagtctccagggcagagtcaccctgaccacagacacgaccacggcctacatggaggtgaggagcctgacatctgacgacacggccgtgtattactgtgcgagagatgtcccaggtgacggggtccacttcatggacgtctggggcaaagggaccacggtcaccgtctcctca

SEQ ID NO: 1186 - protein, 119 aa, Artificial Sequence
  Description of Artificial Sequence: Synthetic heavy chain variable region
QVQLVQSGSEVKKPGASVTVSCKASGYRFSNYGVSWVRQAPGQGLEWMGWISAYNGNTKYGNSLQGRVTLTTDTTTAYMEVRSLTSDDTAVYYCARDVPGDGVHFMDVWGKGTTVTVSS

SEQ ID NO: 1187 - protein, 9 aa, Artificial Sequence
  Description of Artificial Sequence: Synthetic heavy chain variable region CDR H1
YRFSNYGVS

SEQ ID NO: 1188 - DNA, 27 bp, Artificial Sequence
  Description of Artificial Sequence: Synthetic heavy chain variable region CDR H1
tacaggttttccaactatggtgtcagc

SEQ ID NO: 1189 - protein, 17 aa, Artificial Sequence
  Description of Artificial Sequence: Synthetic heavy chain variable region CDR H2
WISAYNGNTKYGNSLQG

SEQ ID NO: 1190 - DNA, 51 bp, Artificial Sequence
  Description of Artificial Sequence: Synthetic heavy chain variable region CDR H2
tggatcagcgcttacaatggaaacacaaagtatggaaatagtctccagggc

SEQ ID NO: 1191 - protein, 14 aa, Artificial Sequence
  Description of Artificial Sequence: Synthetic heavy chain variable region CDR H3
ARDVPGDGVHFMDV

SEQ ID NO: 1192 - DNA, 42 bp, Artificial Sequence
  Description of Artificial Sequence: Synthetic heavy chain variable region CDR H3
gcgagagatgtcccaggtgacggggtccacttcatggacgtc

SEQ ID NO: 1193 - DNA, 336 bp, Artificial Sequence
  Description of Artificial Sequence: Synthetic light chain variable region
gaaattgtgatgacgcagtctccactctccctgcccgtcacccttggacagtcggcctccatctcctgcaggtcgagtcaaagcctcgtacacagtgatactaacacctacttgacctggtttcagcagaggccaggccaatctccacggcgcctcatttataaggtttctcaccgggactctggggtcccagacagattcagcggcagtgggtcaggcactacttttacactgaaaatcagcagggtggaggctgaggatgttggaatttattactgcatggagggttcacactgggctccgactttcggccaggggaccaaggtggaaatcaaa

SEQ ID NO: 1194 - protein, 112 aa, Artificial Sequence
  Description of Artificial Sequence: Synthetic light chain variable region
EIVMTQSPLSLPVTLGQSASISCRSSQSLVHSDTNTYLTWFQQRPGQSPRRLIYKVSHRDSGVPDRFSGSGSGTTFTLKISRVEAEDVGIYYCMEGSHWAPTFGQGTKVEIK

SEQ ID NO: 1195 - protein, 16 aa, Artificial Sequence
  Description of Artificial Sequence: Synthetic light chain variable region CDR L1
RSSQSLVHSDTNTYLT

SEQ ID NO: 1196 - DNA, 48 bp, Artificial Sequence
  Description of Artificial Sequence: Synthetic light chain variable region CDR L1
aggtcgagtcaaagcctcgtacacagtgatactaacacctacttgacc

SEQ ID NO: 1197 - protein, 7 aa, Artificial Sequence
  Description of Artificial Sequence: Synthetic light chain variable region CDR L2
KVSHRDS

SEQ ID NO: 1198 - DNA, 21 bp, Artificial Sequence
  Description of Artificial Sequence: Synthetic light chain variable region CDR L2
aaggtttctcaccgggactct

SEQ ID NO: 1199 - protein, 9 aa, Artificial Sequence
  Description of Artificial Sequence: Synthetic light chain variable region CDR L3
MEGSHWAPT

SEQ ID NO: 1200 - DNA, 27 bp, Artificial Sequence
  Description of Artificial Sequence: Synthetic light chain variable region CDR L3
atggagggttcacactgggctccgact

SEQ ID NO: 1201 - DNA, 354 bp, Artificial Sequence
  Description of Artificial Sequence: Synthetic heavy chain variable region
caggtccagcttgtgcagtctgggggaggcgttgtccagcctgggagctccctgagactctcctgttcagcgtctggatttaccttcatgacctatggcatgcactgggcccgccaggctccaggcaaggggctggagtgggtcgcagatatttcctttgatgcaaataagaaatactatagagattccgtgaagggccgattcaccatctccagggacaattccaagaacacggtgtatctgcaaatgaacagcctgagacccgaggacacggctgtctacttctgtgcgagaaatacgatttttggagtagttgactactggggccagggaaccctggtcaccgtctcctca

SEQ ID NO: 1202 - protein, 118 aa, Artificial Sequence
  Description of Artificial Sequence: Synthetic heavy chain variable region
QVQLVQSGGGVVQPGSSLRLSCSASGFTFMTYGMHWARQAPGKGLEWVADISFDANKKYYRDSVKGRFTISRDNSKNTVYLQMNSLRPEDTAVYFCARNTIFGVVDYWGQGTLVTVSS

SEQ ID NO: 1203 - protein, 9 aa, Artificial Sequence
  Description of Artificial Sequence: Synthetic heavy chain variable region CDR H1
FTFMTYGMH

SEQ ID NO: 1204 - DNA, 27 bp, Artificial Sequence
  Description of Artificial Sequence: Synthetic heavy chain variable region CDR H1
tttaccttcatgacctatggcatgcac

SEQ ID NO: 1205 - protein, 17 aa, Artificial Sequence
  Description of Artificial Sequence: Synthetic heavy chain variable region CDR H2
DISFDANKKYYRDSVKG

SEQ ID NO: 1206 - DNA, 51 bp, Artificial Sequence
  Description of Artificial Sequence: Synthetic heavy chain variable region CDR H2
gatatttcctttgatgcaaataagaaatactatagagattccgtgaagggc

SEQ ID NO: 1207 - protein, 11 aa, Artificial Sequence
  Description of Artificial Sequence: Synthetic heavy chain variable region CDR H3
ARNTIFGVVDY

SEQ ID NO: 1208 - DNA, 33 bp, Artificial Sequence
  Description of Artificial Sequence: Synthetic heavy chain variable region CDR H3
gcgagaaatacgatttttggagtagttgactac

SEQ ID NO: 1209 - DNA, 324 bp, Artificial Sequence
  Description of Artificial Sequence: Synthetic light chain variable region
gaaattgtattgacacagtctccagccaccctgtctgtgtctccaggggaaagagccaccctctcctgcagggccagtcagagtgttagcgccaacttagcctggtaccagcataaacctggccaggctcccaggctcctcatctatggtgcgtccaccagggccagtgatatcccagccaggttcagtggcagtgggtctgggacagagttcactctcaccatcagcagcctgcagtctgaagattctgcagtttattactgtcagcagtataataactggcctccgtggacgttcggccaagggaccaaggtggaaatcaaa

SEQ ID NO: 1210 - protein, 108 aa, Artificial Sequence
  Description of Artificial Sequence: Synthetic light chain variable region
EIVLTQSPATLSVSPGERATLSCRASQSVSANLAWYQHKPGQAPRLLIYGASTRASDIPARFSGSGSGTEFTLTISSLQSEDSAVYYCQQYNNWPPWTFGQGTKVEIK

SEQ ID NO: 1211 - protein, 11 aa, Artificial Sequence
  Description of Artificial Sequence: Synthetic light chain variable region CDR L1
RASQSVSANLA

SEQ ID NO: 1212 - DNA, 33 bp, Artificial Sequence
  Description of Artificial Sequence: Synthetic light chain variable region CDR L1
agggccagtcagagtgttagcgccaacttagcc

SEQ ID NO: 1213 - protein, 7 aa, Artificial Sequence
  Description of Artificial Sequence: Synthetic light chain variable region CDR L2
GASTRAS

SEQ ID NO: 1214 - DNA, 21 bp, Artificial Sequence
  Description of Artificial Sequence: Synthetic light chain variable region CDR L2
ggtgcgtccaccagggccagt

SEQ ID NO: 1215 - protein, 10 aa, Artificial Sequence [sequence omitted]

SEQ ID NO: 1216 - DNA, 30 bp, Artificial Sequence
  Description of Artificial Sequence: Synthetic light chain variable region CDR L3
cagcagtataataactggcctccgtggacg

SEQ ID NO: 1217 - DNA, 366 bp, Artificial Sequence
  Description of Artificial Sequence: Synthetic heavy chain variable region
caggtccagctggtgcagtctggagttgaggtgaagaagcctggggcctcagtgaaggtctcctgcaagacttctggttacacctttagtaattatggtgtcacctgggtgcgacaggcccctggacaagggcttgagtacatgggatggatcagcgcttacaatggtaacacaaactatgcccagaatgtccagggtcgactcaccatgaccacagacacatccacgagcacaggctacatggagttgaggaggctgacatctgacgacacggccgtgtatttctgtgcgagagataaaggtgtaacagtggccggttcattgcttgactactggggccagggaaccctggtcaccgtctcctca

SEQ ID NO: 1218 - protein, 122 aa, Artificial Sequence
  Description of Artificial Sequence: Synthetic heavy chain variable region
QVQLVQSGVEVKKPGASVKVSCKTSGYTFSNYGVTWVRQAPGQGLEYMGWISAYNGNTNYAQNVQGRLTMTTDTSTSTGYMELRRLTSDDTAVYFCARDKGVTVAGSLLDYWGQGTLVTVSS

SEQ ID NO: 1219 - protein, 9 aa, Artificial Sequence
  Description of Artificial Sequence: Synthetic heavy chain variable region CDR H1
YTFSNYGVT

SEQ ID NO: 1220 - DNA, 27 bp, Artificial Sequence
  Description of Artificial Sequence: Synthetic heavy chain variable region CDR H1
tacacctttagtaattatggtgtcacc

SEQ ID NO: 1221 - protein, 17 aa, Artificial Sequence
  Description of Artificial Sequence: Synthetic heavy chain variable region CDR H2
WISAYNGNTNYAQNVQG

SEQ ID NO: 1222 - DNA, 51 bp, Artificial Sequence
  Description of Artificial Sequence: Synthetic heavy chain variable region CDR H2
tggatcagcgcttacaatggtaacacaaactatgcccagaatgtccagggt

SEQ ID NO: 1223 - protein, 15 aa, Artificial Sequence
  Description of Artificial Sequence: Synthetic heavy chain variable region CDR H3
ARDKGVTVAGSLLDY

SEQ ID NO: 1224 - DNA, 45 bp, Artificial Sequence
  Description of Artificial Sequence: Synthetic heavy chain variable region CDR H3
gcgagagataaaggtgtaacagtggccggttcattgcttgactac

SEQ ID NO: 1225 - DNA, 339 bp, Artificial Sequence
  Description of Artificial Sequence: Synthetic light chain variable region
gaaattgtgatgacacagtctccactctccctgcccgtcacccttggacagccggcctccatctcctgcaggtctagtcaaagtctcgaacatagtgatggaaacacctacttgaattggtttcagcagaggccaggccaatctccaaggcgcctcatttataaggtttctaaccgggactctggggtcccagacagattcagcggcagtgggtcaggcactgatttcacactgaaaatcaacagggtggaggctgaggatgttggggtttattactgcatggaaagtacacactggcctccgtacacttttggccaggggaccaaggtggagatcaaa

SEQ ID NO: 1226 - protein, 113 aa, Artificial Sequence
  Description of Artificial Sequence: Synthetic light chain variable region
EIVMTQSPLSLPVTLGQPASISCRSSQSLEHSDGNTYLNWFQQRPGQSPRRLIYKVSNRDSGVPDRFSGSGSGTDFTLKINRVEAEDVGVYYCMESTHWPPYTFGQGTKVEIK

SEQ ID NO: 1227 - protein, 16 aa, Artificial Sequence
  Description of Artificial Sequence: Synthetic light chain variable region CDR L1
RSSQSLEHSDGNTYLN

SEQ ID NO: 1228 - DNA, 48 bp, Artificial Sequence
  Description of Artificial Sequence: Synthetic light chain variable region CDR L1
aggtctagtcaaagtctcgaacatagtgatggaaacacctacttgaat

SEQ ID NO: 1229 - protein, 7 aa, Artificial Sequence
  Description of Artificial Sequence: Synthetic light chain variable region CDR L2
KVSNRDS

SEQ ID NO: 1230 - DNA, 21 bp, Artificial Sequence
  Description of Artificial Sequence: Synthetic light chain variable region CDR L2
aaggtttctaaccgggactct

SEQ ID NO: 1231 - protein, 10 aa, Artificial Sequence
  Description of Artificial Sequence: Synthetic light chain variable region CDR L3
MESTHWPPYT

SEQ ID NO: 1232 - DNA, 30 bp, Artificial Sequence
  Description of Artificial Sequence: Synthetic light chain variable region CDR L3
atggaaagtacacactggcctccgtacact

SEQ ID NO: 1233 - DNA, 360 bp, Artificial Sequence
  Description of Artificial Sequence: Synthetic heavy chain variable region
caggtccagctggtgcagtctggacctgaggtgaagaagcctggggcctcagtgcgggtctcctgcaagacttctggtttcaccttgtcccattatggtgtcagttggctgcggcaggcccctggacacggacttgagtggctgggctggatcagcgcttacaactataacacacaatttggacacagaatggagggcaggctcaccatgaccacagacacttccacagcctatatggacctgacgagcctgacttctgacgacacggccatatattactgtgcgagagattccccttcagacacagcggcagcactccttgacttctggggccagggaaccctggtcaccgtctcctca

SEQ ID NO: 1234 - protein, 120 aa, Artificial Sequence
  Description of Artificial Sequence: Synthetic heavy chain variable region
QVQLVQSGPEVKKPGASVRVSCKTSGFTLSHYGVSWLRQAPGHGLEWLGWISAYNYNTQFGHRMEGRLTMTTDTSTAYMDLTSLTSDDTAIYYCARDSPSDTAAALLDFWGQGTLVTVSS

SEQ ID NO: 1235 - protein, 9 aa, Artificial Sequence
  Description of Artificial Sequence: Synthetic heavy chain variable region CDR H1
FTLSHYGVS

SEQ ID NO: 1236 - DNA, 27 bp, Artificial Sequence
  Description of Artificial Sequence: Synthetic heavy chain variable region CDR H1
ttcaccttgtcccattatggtgtcagt

SEQ ID NO: 1237 - protein, 17 aa, Artificial Sequence
  Description of Artificial Sequence: Synthetic heavy chain variable region CDR H2
WISAYNYNTQFGHRMEG

SEQ ID NO: 1238 - DNA, 51 bp, Artificial Sequence
  Description of Artificial Sequence: Synthetic heavy chain variable region CDR H2
tggatcagcgcttacaactataacacacaatttggacacagaatggagggc

SEQ ID NO: 1239 - protein, 15 aa, Artificial Sequence
  Description of Artificial Sequence: Synthetic heavy chain variable region CDR H3
ARDSPSDTAAALLDF

SEQ ID NO: 1240 - DNA, 45 bp, Artificial Sequence
  Description of Artificial Sequence: Synthetic heavy chain variable region CDR H3
gcgagagattccccttcagacacagcggcagcactccttgacttc

SEQ ID NO: 1241 - DNA, 339 bp, Artificial Sequence
  Description of Artificial Sequence: Synthetic light chain variable region
gatattgtgctgactcagtctcccctctccctgcccgtcactcttggacagccggcctccatctcctgcaggtctagtcaaagcctcgtatacagtgatggcaacacctacttgagttggtttcagcagaggccaggccaagctccaaggcgcctaatttataagatttctaaccgagactctggggtcccagacagattcagcggcagtgggtcaggcactgatttcacactaaagatcagcagggtggaggctgaggatgttgggatttattactgcatgcaagctacacactggcctcgtctcagtttcggcggagggaccaaggtggagatcaaa

SEQ ID NO: 1242 - protein, 113 aa, Artificial Sequence
  Description of Artificial Sequence: Synthetic light chain variable region
DIVLTQSPLSLPVTLGQPASISCRSSQSLVYSDGNTYLSWFQQRPGQAPRRLIYKISNRDSGVPDRFSGSGSGTDFTLKISRVEAEDVGIYYCMQATHWPRLSFGGGTKVEIK

SEQ ID NO: 1243 - protein, 16 aa, Artificial Sequence
  Description of Artificial Sequence: Synthetic light chain variable region CDR L1
RSSQSLVYSDGNTYLS

SEQ ID NO: 1244 - DNA, 48 bp, Artificial Sequence
  Description of Artificial Sequence: Synthetic light chain variable region CDR L1
aggtctagtcaaagcctcgtatacagtgatggcaacacctacttgagt

SEQ ID NO: 1245 - protein, 7 aa, Artificial Sequence
  Description of Artificial Sequence: Synthetic light chain variable region CDR L2
KISNRDS

SEQ ID NO: 1246 - DNA, 21 bp, Artificial Sequence
  Description of Artificial Sequence: Synthetic light chain variable region CDR L2
aagatttctaaccgagactct

SEQ ID NO: 1247 - protein, 10 aa, Artificial Sequence
  Description of Artificial Sequence: Synthetic light chain variable region CDR L3
MQATHWPRLS

SEQ ID NO: 1248 - DNA, 30 bp, Artificial Sequence
  Description of Artificial Sequence: Synthetic light chain variable region CDR L3
atgcaagctacacactggcctcgtctcagt

SEQ ID NO: 1249 - DNA, 354 bp, Artificial Sequence
  Description of Artificial Sequence: Synthetic heavy chain variable region
gaggtgcagctggtggagtctggggctgaaatgaagcagcctggggcctcagtgaaagtctcctgcgagggttttggaaacactctcagtgaaagatccatacactgggtgcgacaggctccaggaaaagggcctgagtggatgggagattatgatcatgaagataaagaagcaatctacgcaccgaagttccagggcagactcacaataagcgcggacatgtctacagacatagcctccttggagctgaacagcctgacatcagaagacacagccgtctattattgtgcgacagtgatcgctgtgggggcttatgacatctggggccagggaaccctggtcaccgtctcctca

SEQ ID NO: 1250 - protein, 118 aa, Artificial Sequence
  Description of Artificial Sequence: Synthetic heavy chain variable region
EVQLVESGAEMKQPGASVKVSCEGFGNTLSERSIHWVRQAPGKGPEWMGDYDHEDKEAIYAPKFQGRLTISADMSTDIASLELNSLTSEDTAVYYCATVIAVGAYDIWGQGTLVTVSS

SEQ ID NO: 1251 - protein, 9 aa, Artificial Sequence
  Description of Artificial Sequence: Synthetic heavy chain variable region CDR H1
NTLSERSIH

SEQ ID NO: 1252 - DNA, 27 bp, Artificial Sequence
  Description of Artificial Sequence: Synthetic heavy chain variable region CDR H1
aacactctcagtgaaagatccatacac

SEQ ID NO: 1253 - protein, 17 aa, Artificial Sequence
  Description of Artificial Sequence: Synthetic heavy chain variable region CDR H2
DYDHEDKEAIYAPKFQG

SEQ ID NO: 1254 - DNA, 51 bp, Artificial Sequence
  Description of Artificial Sequence: Synthetic heavy chain variable region CDR H2
gattatgatcatgaagataaagaagcaatctacgcaccgaagttccagggc

SEQ ID NO: 1255 - protein, 11 aa, Artificial Sequence
  Description of Artificial Sequence: Synthetic heavy chain variable region CDR H3
ATVIAVGAYDI

SEQ ID NO: 1256 - DNA, 33 bp, Artificial Sequence
  Description of Artificial Sequence: Synthetic heavy chain variable region CDR H3
gcgacagtgatcgctgtgggggcttatgacatc

SEQ ID NO: 1257 - DNA, 321 bp, Artificial Sequence
  Description of Artificial Sequence: Synthetic light chain variable region
gaaattgtattgacacagtctccatcctccctgtatgcgtctataggggacagagtcaccatcacttgccggactggtcagagcatttcccggtatttgaattggtatcagcagaaacctgggaaagcccctaaactcctgatctatgcagcatccactttgcaaagtggggtcccatcacgtttcagtggcagtggcgctgggacagatttcactctcaccatcagaggtctgctacctgaagattttgcaacttacttctgtcaacagagttacattatcccctacacttttggccaggggaccaaggtggaaatcaaa

SEQ ID NO: 1258 - protein, 107 aa, Artificial Sequence
  Description of Artificial Sequence: Synthetic light chain variable region
EIVLTQSPSSLYASIGDRVTITCRTGQSISRYLNWYQQKPGKAPKLLIYAASTLQSGVPSRFSGSGAGTDFTLTIRGLLPEDFATYFCQQSYIIPYTFGQGTKVEIK

SEQ ID NO: 1259 - protein, 11 aa, Artificial Sequence
  Description of Artificial Sequence: Synthetic light chain variable region CDR L1
RTGQSISRYLN

SEQ ID NO: 1260 - DNA, 33 bp, Artificial Sequence
  Description of Artificial Sequence: Synthetic light chain variable region CDR L1
cggactggtcagagcatttcccggtatttgaat

SEQ ID NO: 1261 - protein, 7 aa, Artificial Sequence
  Description of Artificial Sequence: Synthetic light chain variable region CDR L2
AASTLQS

SEQ ID NO: 1262 - DNA, 21 bp, Artificial Sequence
  Description of Artificial Sequence: Synthetic light chain variable region CDR L2
gcagcatccactttgcaaagt

SEQ ID NO: 1263 - protein, 9 aa, Artificial Sequence
  Description of Artificial Sequence: Synthetic light chain variable region CDR L3
QQSYIIPYT

SEQ ID NO: 1264 - DNA, 27 bp, Artificial Sequence
  Description of Artificial Sequence: Synthetic light chain variable region CDR L3
caacagagttacattatcccctacact

SEQ ID NO: 1265 - DNA, 366 bp, Artificial Sequence
  Description of Artificial Sequence: Synthetic heavy chain variable region
caggtgcagctacagcagtggggcgcaggactggtgaagccttcggagaccctgtccctcacctgcgctgtgtatggtgggtccttcagtggttaccagtggcactggttccgccagcccccagggaagggtctggagtggattggggaaatcaatcatagtgaaatcacccactacaacgcgtccctcaagagtcgagtcaccctatctattgacacgtccaagaaccaattctccctgaacctgacctctgtgaccgccgcggacacggctgtttattactgtgcgagagcctcgagtgggagctataacttcgaatactggttcgacccctggggccagggaaccctggtcaccgtctcctca

SEQ ID NO: 1266 - protein, 122 aa, Artificial Sequence
  Description of Artificial Sequence: Synthetic heavy chain variable region
QVQLQQWGAGLVKPSETLSLTCAVYGGSFSGYQWHWFRQPPGKGLEWIGEINHSEITHYNASLKSRVTLSIDTSKNQFSLNLTSVTAADTAVYYCARASSGSYNFEYWFDPWGQGTLVTVSS

SEQ ID NO: 1267 - protein, 9 aa, Artificial Sequence
  Description of Artificial Sequence: Synthetic heavy chain variable region CDR H1
GSFSGYQWH

SEQ ID NO: 1268 - DNA, 27 bp, Artificial Sequence
  Description of Artificial Sequence: Synthetic heavy chain variable region CDR H1
gggtccttcagtggttaccagtggcac

SEQ ID NO: 1269 - protein, 16 aa, Artificial Sequence
  Description of Artificial Sequence: Synthetic heavy chain variable region CDR H2
EINHSEITHYNASLKS

SEQ ID NO: 1270 - DNA, 48 bp, Artificial Sequence
  Description of Artificial Sequence: Synthetic heavy chain variable region CDR H2
gaaatcaatcatagtgaaatcacccactacaacgcgtccctcaagagt

SEQ ID NO: 1271 - protein, 16 aa, Artificial Sequence
  Description of Artificial Sequence: Synthetic heavy chain variable region CDR H3
ARASSGSYNFEYWFDP

SEQ ID NO: 1272 - DNA, 48 bp, Artificial Sequence
  Description of Artificial Sequence: Synthetic heavy chain variable region CDR H3
gcgagagcctcgagtgggagctataacttcgaatactggttcgacccc

SEQ ID NO: 1273 - DNA, 324 bp, Artificial Sequence
  Description of Artificial Sequence: Synthetic light chain variable region
cagtctgtgctgacgcagccgccctcggtgtccgtggccccaggaaagacggcctggcttacctgtgggggaaacaacattggcagtaagagagtgcactggtaccggcagaagccaggccaggcccctgtgctggtcgtttatgatgattacgaccggccctcagggacccctgagcgagtctctggctccaactctgggaacacggccaccctgaccatcagcagggtcgaagacggggatgagggcgactattattgtcaggtgtgggatgatcccagtgatcatgcggtgttcggcggcgggaccaagctgaccgtccta

SEQ ID NO: 1274 - protein, 108 aa, Artificial Sequence
  Description of Artificial Sequence: Synthetic light chain variable region
QSVLTQPPSVSVAPGKTAWLTCGGNNIGSKRVHWYRQKPGQAPVLVVYDDYDRPSGTPERVSGSNSGNTATLTISRVEDGDEGDYYCQVWDDPSDHAVFGGGTKLTVL

SEQ ID NO: 1275 - protein, 11 aa, Artificial Sequence
  Description of Artificial Sequence: Synthetic light chain variable region CDR L1
GGNNIGSKRVH

SEQ ID NO: 1276 - DNA, 33 bp, Artificial Sequence
  Description of Artificial Sequence: Synthetic light chain variable region CDR L1
gggggaaacaacattggcagtaagagagtgcac

SEQ ID NO: 1277 - protein, 7 aa, Artificial Sequence
  Description of Artificial Sequence: Synthetic light chain variable region CDR L2
DDYDRPS

SEQ ID NO: 1278 - DNA, 21 bp, Artificial Sequence
  Description of Artificial Sequence: Synthetic light chain variable region CDR L2
gatgattacgaccggccctca

SEQ ID NO: 1279 - protein, 11 aa, Artificial Sequence
  Description of Artificial Sequence: Synthetic light chain variable region CDR L3
QVWDDPSDHAV

SEQ ID NO: 1280 - DNA, 33 bp, Artificial Sequence; identical to SEQ ID NO: 688
  Description of Artificial Sequence: Synthetic light chain variable region CDR L3

SEQ ID NO: 1281 - DNA, 366 bp, Artificial Sequence
  Description of Artificial Sequence: Synthetic heavy chain variable region
caggtccagcttgtgcagtctggaactgaggttaagaagcctggggcctcagtgaaggtctcctgcttgacttctggctacacctttacacactttggtatcagctgggtgcgacaggccccaggacaagggcttgagtggatgggatggttcagcgcttacaatggtaacacaaagtatgcacagaagttccagggcagaatcaccctcaccatagacacatccacgagcatcgcctacttggaactgaggagcctgagatctgacgacacggccgtatattattgtgcgagagaccccccgagtctgacagcagctggtactctggactactggggccagggaaccctggtcaccgtctcctca

SEQ ID NO: 1282 - protein, 122 aa, Artificial Sequence
  Description of Artificial Sequence: Synthetic heavy chain variable region
QVQLVQSGTEVKKPGASVKVSCLTSGYTFTHFGISWVRQAPGQGLEWMGWFSAYNGNTKYAQKFQGRITLTIDTSTSIAYLELRSLRSDDTAVYYCARDPPSLTAAGTLDYWGQGTLVTVSS

SEQ ID NO: 1283 - protein, 9 aa, Artificial Sequence
  Description of Artificial Sequence: Synthetic heavy chain variable region CDR H1
YTFTHFGIS

SEQ ID NO: 1284 - DNA, 27 bp, Artificial Sequence
  Description of Artificial Sequence: Synthetic heavy chain variable region CDR H1
tacacctttacacactttggtatcagc

SEQ ID NO: 1285 - protein, 17 aa, Artificial Sequence
  Description of Artificial Sequence: Synthetic heavy chain variable region CDR H2
WFSAYNGNTKYAQKFQG

SEQ ID NO: 1286 - DNA, 51 bp, Artificial Sequence
  Description of Artificial Sequence: Synthetic heavy chain variable region CDR H2
tggttcagcgcttacaatggtaacacaaagtatgcacagaagttccagggc

SEQ ID NO: 1287 - protein, 15 aa, Artificial Sequence
  Description of Artificial Sequence: Synthetic heavy chain variable region CDR H3
ARDPPSLTAAGTLDY

SEQ ID NO: 1288 - DNA, 45 bp, Artificial Sequence
  Description of Artificial Sequence: Synthetic heavy chain variable region CDR H3
gcgagagaccccccgagtctgacagcagctggtactctggactac

SEQ ID NO: 1289 - DNA, 336 bp, Artificial Sequence
  Description of Artificial Sequence: Synthetic light chain variable region
gacatccggttgacccagtctccactctccctgcccgtcacccttggacagccggcctccatctcctgcagctctaatcaaagcctcgtatacagtgatggaaacacctacttgagttggtttcagcagaggccaggccaatctccaaggcgcctaatttataaggtttctgatcgggactctggggtcccagacagattcagcggcagtgggtcaggcactgatttcacactgaaaatcagcagggtggaggctgaggatgttggggtttattactgcatgcaagctacagactggccccggacgttcggccaagggaccaaggtggagatcaaa

SEQ ID NO: 1290 - protein, 112 aa, Artificial Sequence
  Description of Artificial Sequence: Synthetic light chain variable region
DIRLTQSPLSLPVTLGQPASISCSSNQSLVYSDGNTYLSWFQQRPGQSPRRLIYKVSDRDSGVPDRFSGSGSGTDFTLKISRVEAEDVGVYYCMQATDWPRTFGQGTKVEIK

SEQ ID NO: 1291 - protein, 16 aa, Artificial Sequence
  Description of Artificial Sequence: Synthetic light chain variable region CDR L1
SSNQSLVYSDGNTYLS

SEQ ID NO: 1292 - DNA, 48 bp, Artificial Sequence
  Description of Artificial Sequence: Synthetic light chain variable region CDR L1
agctctaatcaaagcctcgtatacagtgatggaaacacctacttgagt

SEQ ID NO: 1293 - protein, 7 aa, Artificial Sequence
  Description of Artificial Sequence: Synthetic light chain variable region CDR L2
KVSDRDS

SEQ ID NO: 1294 - DNA, 21 bp, Artificial Sequence
  Description of Artificial Sequence: Synthetic light chain variable region CDR L2
aaggtttctgatcgggactct

SEQ ID NO: 1295 - protein, 9 aa, Artificial Sequence
  Description of Artificial Sequence: Synthetic light chain variable region CDR L3
MQATDWPRT

SEQ ID NO: 1296 - DNA, 27 bp, Artificial Sequence
  Description of Artificial Sequence: Synthetic light chain variable region CDR L3
atgcaagctacagactggccccggacg

SEQ ID NO: 1297 - DNA, 357 bp, Artificial Sequence
  Description of Artificial Sequence: Synthetic heavy chain variable region
gaggtgcagctggtggagtctggggctgaggtgaagaagcctggggactcagtgaaggtctcctgcagggcttctggatacagcttcaccggcccctttttgcactgggtgcgacaggcccctggacagcggcttgagcacatgggatggatcaaccctagaagtggtgaaacaaaatatgcacagtcctttctgggcagggtcaccatgaccagggacacgtccattcgctcagccaccttggaattgagtagcctgagatctgacgacacggccgtgtattattgtgcgagagacctctatagcagtggctggctcgacaactggggccagggaaccctggtcaccgtctcctca

SEQ ID NO: 1298 - protein, 119 aa, Artificial Sequence
  Description of Artificial Sequence: Synthetic heavy chain variable region
EVQLVESGAEVKKPGDSVKVSCRASGYSFTGPFLHWVRQAPGQRLEHMGWINPRSGETKYAQSFLGRVTMTRDTSIRSATLELSSLRSDDTAVYYCARDLYSSGWLDNWGQGTLVTVSS

SEQ ID NO: 1299 - protein, 9 aa, Artificial Sequence
  Description of Artificial Sequence: Synthetic heavy chain variable region CDR H1
YSFTGPFLH

SEQ ID NO: 1300 - DNA, 27 bp, Artificial Sequence
  Description of Artificial Sequence: Synthetic heavy chain variable region CDR H1
tacagcttcaccggcccctttttgcac

SEQ ID NO: 1301 - protein, 17 aa, Artificial Sequence
  Description of Artificial Sequence: Synthetic heavy chain variable region CDR H2
WINPRSGETKYAQSFLG

SEQ ID NO: 1302 - DNA, 51 bp, Artificial Sequence
  Description of Artificial Sequence: Synthetic heavy chain variable region CDR H2
tggatcaaccctagaagtggtgaaacaaaatatgcacagtcctttctgggc

SEQ ID NO: 1303 - protein, 12 aa, Artificial Sequence
  Description of Artificial Sequence: Synthetic heavy chain variable region CDR H3
ARDLYSSGWLDN

SEQ ID NO: 1304 - DNA, 36 bp, Artificial Sequence
  Description of Artificial Sequence: Synthetic heavy chain variable region CDR H3
gcgagagacctctatagcagtggctggctcgacaac

SEQ ID NO: 1305 - DNA, 321 bp, Artificial Sequence
  Description of Artificial Sequence: Synthetic light chain variable region
gaaacgacactcacgcagtctccagccaccctgtctgtgtctccaggggaaagggccaccctctcctgcagggccagtcagggtcttagcagcaacttagcctggtaccagcacaaacctggccaggctcccaggctcctcgtctatggtgttgccaccagggccactggtgtcccagccaggttcagtggcagtgggtctgggacagagttcactctcaccatcagcagcctgcagtctgacgattttgcactttattactgtcatcagtataatgactggccctacacttttggccaggggaccaagctggagatcaaa

SEQ ID NO: 1306 - protein, 107 aa, Artificial Sequence
  Description of Artificial Sequence: Synthetic light chain variable region
ETTLTQSPATLSVSPGERATLSCRASQGLSSNLAWYQHKPGQAPRLLVYGVATRATGVPARFSGSGSGTEFTLTISSLQSDDFALYYCHQYNDWPYTFGQGTKLEIK

SEQ ID NO: 1307 - protein, 11 aa, Artificial Sequence
  Description of Artificial Sequence: Synthetic light chain variable region CDR L1
RASQGLSSNLA

SEQ ID NO: 1308 - DNA, 33 bp, Artificial Sequence
  Description of Artificial Sequence: Synthetic light chain variable region CDR L1
agggccagtcagggtcttagcagcaacttagcc

SEQ ID NO: 1309 - protein, 7 aa, Artificial Sequence
  Description of Artificial Sequence: Synthetic light chain variable region CDR L2
GVATRAT

SEQ ID NO: 1310 - DNA, 21 bp, Artificial Sequence
  Description of Artificial Sequence: Synthetic light chain variable region CDR L2
ggtgttgccaccagggccact

SEQ ID NO: 1311 - protein, 9 aa, Artificial Sequence
  Description of Artificial Sequence: Synthetic light chain variable region CDR L3
HQYNDWPYT

SEQ ID NO: 1312 - DNA, 27 bp, Artificial Sequence
  Description of Artificial Sequence: Synthetic light chain variable region CDR L3
catcagtataatgactggccctacact

SEQ ID NO: 1313 - DNA, 384 bp, Artificial Sequence
  Description of Artificial Sequence: Synthetic heavy chain variable region
gaggtgcagctggtggagtctgggggaggcttggtaaagcctggggggtccctaagactctcatgtgcagcctctggattcatcttccgcaacgcctggatgagctgggtccgccaggctccagggaaggggctggagtgggttggccggattaaaaggacaagtgaaggtgggtcagtcgactacgcgacacccgtgcaaggcagattctccatctcaagagatgattctagaaacacgctgtatctgcaaatgaacagcctggaaaccgacgacacagccgtgtattactgttccacaggcccaccctactcttactttgatagtagtggttattcggtcgtggactactggggccagggaaccctggtcaccgtctcctca

SEQ ID NO: 1314 - protein, 128 aa, Artificial Sequence
  Description of Artificial Sequence: Synthetic heavy chain variable region
EVQLVESGGGLVKPGGSLRLSCAASGFIFRNAWMSWVRQAPGKGLEWVGRIKRTSEGGSVDYATPVQGRFSISRDDSRNTLYLQMNSLETDDTAVYYCSTGPPYSYFDSSGYSVVDYWGQGTLVTVSS

SEQ ID NO: 1315 - protein, 9 aa, Artificial Sequence
  Description of Artificial Sequence: Synthetic heavy chain variable region CDR H1
FIFRNAWMS

SEQ ID NO: 1316 - DNA, 27 bp, Artificial Sequence
  Description of Artificial Sequence: Synthetic heavy chain variable region CDR H1
ttcatcttccgcaacgcctggatgagc

SEQ ID NO: 1317 - protein, 19 aa, Artificial Sequence
  Description of Artificial Sequence: Synthetic heavy chain variable region CDR H2
RIKRTSEGGSVDYATPVQG

SEQ ID NO: 1318 - DNA, 57 bp, Artificial Sequence
  Description of Artificial Sequence: Synthetic heavy chain variable region CDR H2
cggattaaaaggacaagtgaaggtgggtcagtcgactacgcgacacccgtgcaaggc

SEQ ID NO: 1319 - protein, 19 aa, Artificial Sequence
  Description of Artificial Sequence: Synthetic heavy chain variable region CDR H3
STGPPYSYFDSSGYSVVDY

SEQ ID NO: 1320 - DNA, 57 bp, Artificial Sequence
  Description of Artificial Sequence: Synthetic heavy chain variable region CDR H3
tccacaggcccaccctactcttactttgatagtagtggttattcggtcgtggactac

SEQ ID NO: 1321 - DNA, 330 bp, Artificial Sequence
  Description of Artificial Sequence: Synthetic light chain variable region
cagtctgtgttgacgcagccgccctcagcgtctgggacccccgggcagagggtcaccatctcttgttctgcaagcagctccaacatcggagataattatttctactggtaccaacaactcccaggaaaggcccccacactcctcatgtatggtagtgatcagcggtcctcaggggtccctgaccgattctctggctcccagtctggcacctctgcctccctggccatcagtgggctccggtccgaggatgaagctgattattattgtgcagcttgggatgacagcctgagtggtccggtgttcggcggagggaccaagctgaccgtccta

SEQ ID NO: 1322 - protein, 110 aa, Artificial Sequence
  Description of Artificial Sequence: Synthetic light chain variable region
QSVLTQPPSASGTPGQRVTISCSASSSNIGDNYFYWYQQLPGKAPTLLMYGSDQRSSGVPDRFSGSQSGTSASLAISGLRSEDEADYYCAAWDDSLSGPVFGGGTKLTVL

SEQ ID NO: 1323 - protein, 13 aa, Artificial Sequence
  Description of Artificial Sequence: Synthetic light chain variable region CDR L1
SASSSNIGDNYFY

SEQ ID NO: 1324 - DNA, 39 bp, Artificial Sequence; identical to SEQ ID NO: 204
  Description of Artificial Sequence: Synthetic light chain variable region CDR L1

SEQ ID NO: 1325 - protein, 7 aa, Artificial Sequence
  Description of Artificial Sequence: Synthetic light chain variable region CDR L2
GSDQRSS

SEQ ID NO: 1326 - DNA, 21 bp, Artificial Sequence
  Description of Artificial Sequence: Synthetic light chain variable region CDR L2
ggtagtgatcagcggtcctca

SEQ ID NO: 1327 - protein, 11 aa, Artificial Sequence
  Description of Artificial Sequence: Synthetic light chain variable region CDR L3
AAWDDSLSGPV

SEQ ID NO: 1328 - DNA, 33 bp, Artificial Sequence; identical to SEQ ID NO: 208
  Description of Artificial Sequence: Synthetic light chain variable region CDR L3

SEQ ID NO: 1329 - DNA, 366 bp, Artificial Sequence
  Description of Artificial Sequence: Synthetic heavy chain variable region
gaggtgcagctggtggagtctgggggaggcttggtacagcctggggggtccctgagactctcgtgtgcagcctctggattctccttcagtgactacagcatgaactgggtccgccaggctccagggaaggggctggagtgggtttcatatattactcctagtagtagaaataaattctatgcagactctgtgaggggccgattcaccatctccagagacaatgccgagaattcactgtatctgcaaatgaacagcctgagagtcgaagacacggctgtttattactgtgtcagaagtttgcattggggcgccgcgatcgagagatgggacgtctggggccaagggaccacggtcaccgtctcctca

SEQ ID NO: 1330 - protein, 122 aa, Artificial Sequence
  Description of Artificial Sequence: Synthetic heavy chain variable region
EVQLVESGGGLVQPGGSLRLSCAASGFSFSDYSMNWVRQAPGKGLEWVSYITPSSRNKFYADSVRGRFTISRDNAENSLYLQMNSLRVEDTAVYYCVRSLHWGAAIERWDVWGQGTTVTVSS

SEQ ID NO: 1331 - protein, 9 aa, Artificial Sequence
  Description of Artificial Sequence: Synthetic heavy chain variable region CDR H1
FSFSDYSMN

SEQ ID NO: 1332 - DNA, 27 bp, Artificial Sequence
  Description of Artificial Sequence: Synthetic heavy chain variable region CDR H1
ttctccttcagtgactacagcatgaac

SEQ ID NO: 1333 - protein, 17 aa, Artificial Sequence
  Description of Artificial Sequence: Synthetic heavy chain variable region CDR H2
YITPSSRNKFYADSVRG

SEQ ID NO: 1334 - DNA, 51 bp, Artificial Sequence
  Description of Artificial Sequence: Synthetic heavy chain variable region CDR H2
tatattactcctagtagtagaaataaattctatgcagactctgtgaggggc

SEQ ID NO: 1335 - protein, 15 aa, Artificial Sequence
  Description of Artificial Sequence: Synthetic heavy chain variable region CDR H3
VRSLHWGAAIERWDV

SEQ ID NO: 1336 - DNA, 45 bp, Artificial Sequence
  Description of Artificial Sequence: Synthetic heavy chain variable region CDR H3
gtcagaagtttgcattggggcgccgcgatcgagagatgggacgtc

SEQ ID NO: 1337 - DNA, 324 bp, Artificial Sequence
  Description of Artificial Sequence: Synthetic light chain variable region
gaaattgtattgacgcagtctccaggcaccctgtcgttgtctccaggggaaagagccaccctctcctgcagggccagtcagagtattagcagcagcttctttgcctggtaccagcagacacctggccaggcccccagactcctcatgtatgctacatccagcagggccactggcatcccagacaggttcagtggcagtgggtctgggacagacttcactctcaccatcagcagagtggagcctgaagattttgcagtgtattactgtcagcagtctggcagttcaccgtacacttttggccaggggaccaaggtggaaatcaaa

SEQ ID NO: 1338 - protein, 108 aa, Artificial Sequence
  Description of Artificial Sequence: Synthetic light chain variable region
EIVLTQSPGTLSLSPGERATLSCRASQSISSSFFAWYQQTPGQAPRLLMYATSSRATGIPDRFSGSGSGTDFTLTISRVEPEDFAVYYCQQSGSSPYTFGQGTKVEIK

SEQ ID NO: 1339 - protein, 12 aa, Artificial Sequence
  Description of Artificial Sequence: Synthetic light chain variable region CDR L1
RASQSISSSFFA

SEQ ID NO: 1340 - DNA, 36 bp, Artificial Sequence
  Description of Artificial Sequence: Synthetic light chain variable region CDR L1
agggccagtcagagtattagcagcagcttctttgcc

SEQ ID NO: 1341 - protein, 7 aa, Artificial Sequence
  Description of Artificial Sequence: Synthetic light chain variable region CDR L2
ATSSRAT

SEQ ID NO: 1342 - DNA, 21 bp, Artificial Sequence
  Description of Artificial Sequence: Synthetic light chain variable region CDR L2
gctacatccagcagggccact

SEQ ID NO: 1343 - protein, 9 aa, Artificial Sequence
  Description of Artificial Sequence: Synthetic light chain variable region CDR L3
QQSGSSPYT

SEQ ID NO: 1344 - DNA, 27 bp, Artificial Sequence
  Description of Artificial Sequence: Synthetic light chain variable region CDR L3
cagcagtctggcagttcaccgtacact

SEQ ID NO: 1345 - DNA, 351 bp, Artificial Sequence
  Description of Artificial Sequence: Synthetic heavy chain variable region
gaggtgcagctgttggagtcggggggaggcgtggtccagcctgggaggtccctgagactctcctgtacagcctctggattcaccttcagtgaccatgctatgtactgggtccgccaggctccaggcaaagggctagagtgggtggcacttatatcatttgatggaaggaatatatactacgcagactccgtgaagggccgattcaccatctccagagacaattccaagaacacgctgtatctgcagatgaacagcctgagagctgaggacacggctgtctattactgtgcgagagatcaatggctggttcctgactactggggccagggaaccctggtcaccgtctcctca

SEQ ID NO: 1346 - protein, 117 aa, Artificial Sequence
  Description of Artificial Sequence: Synthetic heavy chain variable region
EVQLLESGGGVVQPGRSLRLSCTASGFTFSDHAMYWVRQAPGKGLEWVALISFDGRNIYYADSVKGRFTISRDNSKNTLYLQMNSLRAEDTAVYYCARDQWLVPDYWGQGTLVTVSS

SEQ ID NO: 1347 - protein, 9 aa, Artificial Sequence
  Description of Artificial Sequence: Synthetic heavy chain variable region CDR H1
FTFSDHAMY

SEQ ID NO: 1348 - DNA, 27 bp, Artificial Sequence
  Description of Artificial Sequence: Synthetic heavy chain variable region CDR H1
ttcaccttcagtgaccatgctatgtac

SEQ ID NO: 1349 - protein, 17 aa, Artificial Sequence
  Description of Artificial Sequence: Synthetic heavy chain variable region CDR H2
LISFDGRNIYYADSVKG

SEQ ID NO: 1350 - DNA, 51 bp, Artificial Sequence; identical to SEQ ID NO: 374
  Description of Artificial Sequence: Synthetic heavy chain variable region CDR H2

SEQ ID NO: 1351 - protein, 10 aa, Artificial Sequence
  Description of Artificial Sequence: Synthetic heavy chain variable region CDR H3
ARDQWLVPDY

SEQ ID NO: 1352 - DNA, 30 bp, Artificial Sequence; identical to SEQ ID NO: 376
  Description of Artificial Sequence: Synthetic heavy chain variable region CDR H3

SEQ ID NO: 1353 - DNA, 327 bp, Artificial Sequence
  Description of Artificial Sequence: Synthetic light chain variable region
cagtctgttctgattcagcctgcctccgtgtctgggtctcctggacagtcgatcaccatctcctgcactggaaccagcagtgacgttggtggttataactatgtctcctggtaccaacagcacccaggcaacgcccccaaactcatgatttatgaagtcagtaagcggccctcaggggtccctgatcgcttctctggcttcaagtctggcaacacggcctccctgaccgtctctgggctccaggctgaggatgaggctgattattactgcagctcatatgcaggcagcaacagtgtcttcggaactggcacccagctgaccgtcctc

SEQ ID NO: 1354 - protein, 109 aa, Artificial Sequence
  Description of Artificial Sequence: Synthetic light chain variable region
QSVLIQPASVSGSPGQSITISCTGTSSDVGGYNYVSWYQQHPGNAPKLMIYEVSKRPSGVPDRFSGFKSGNTASLTVSGLQAEDEADYYCSSYAGSNSVFGTGTQLTVL

SEQ ID NO: 1355 - protein, 14 aa, Artificial Sequence
  Description of Artificial Sequence: Synthetic light chain variable region CDR L1
TGTSSDVGGYNYVS

SEQ ID NO: 1356 - DNA, 42 bp, Artificial Sequence; identical to SEQ ID NO: 380
  Description of Artificial Sequence: Synthetic light chain variable region CDR L1

SEQ ID NO: 1357 - protein, 7 aa, Artificial Sequence
  Description of Artificial Sequence: Synthetic light chain variable region CDR L2
EVSKRPS

SEQ ID NO: 1358 - DNA, 21 bp, Artificial Sequence
  Description of Artificial Sequence: Synthetic light chain variable region CDR L2
gaagtcagtaagcggccctca

SEQ ID NO: 1359 - protein, 9 aa, Artificial Sequence
  Description of Artificial Sequence: Synthetic light chain variable region CDR L3
SSYAGSNSV

SEQ ID NO: 1360 - DNA, 27 bp, Artificial Sequence
  Description of Artificial Sequence: Synthetic light chain variable region CDR L3
agctcatatgcaggcagcaacagtgtc

SEQ ID NO: 1361 - DNA, 366 bp, Artificial Sequence
  Description of Artificial Sequence: Synthetic heavy chain variable region
gaggtgcagctggtggagtcgggcccaggactagttaggccttcacagaccctgtccataaagtgcagtgtctctggcggctccatcaatagaggtgcttacttctggacctggatccgccagcgcccagggaagggcctggagtggattgggtccatccatgacaccggcagctactacaacccgtccctcaagacacgagtttccatctccggggacacgtctaaaaacctcttcaccctggagttgacctcgctgactgccgcggacacggccgtgtattactgtgcgagggggcgtggatacagctatggctggcgttactttgactcctggggccagggaaccctggtcaccgtctcctca

SEQ ID NO: 1362 - protein, 122 aa, Artificial Sequence
  Description of Artificial Sequence: Synthetic heavy chain variable region
EVQLVESGPGLVRPSQTLSIKCSVSGGSINRGAYFWTWIRQRPGKGLEWIGSIHDTGSYYNPSLKTRVSISGDTSKNLFTLELTSLTAADTAVYYCARGRGYSYGWRYFDSWGQGTLVTVSS

SEQ ID NO: 1363 - protein, 11 aa, Artificial Sequence
  Description of Artificial Sequence: Synthetic heavy chain variable region CDR H1
GSINRGAYFWT

SEQ ID NO: 1364 - DNA, 33 bp, Artificial Sequence
  Description of Artificial Sequence: Synthetic heavy chain variable region CDR H1
ggctccatcaatagaggtgcttacttctggacc

SEQ ID NO: 1365 - protein, 15 aa, Artificial Sequence
  Description of Artificial Sequence: Synthetic heavy chain variable region CDR H2
SIHDTGSYYNPSLKT

SEQ ID NO: 1366 - DNA, 45 bp, Artificial Sequence
  Description of Artificial Sequence: Synthetic heavy chain variable region CDR H2
tccatccatgacaccggcagctactacaacccgtccctcaagaca

SEQ ID NO: 1367 - protein, 15 aa, Artificial Sequence
  Description of Artificial Sequence: Synthetic heavy chain variable region CDR H3
ARGRGYSYGWRYFDS

SEQ ID NO: 1368 - DNA, 45 bp, Artificial Sequence
  Description of Artificial Sequence: Synthetic heavy chain variable region CDR H3
gcgagggggcgtggatacagctatggctggcgttactttgactcc

SEQ ID NO: 1369 - DNA, 324 bp, Artificial Sequence
  Description of Artificial Sequence: Synthetic light chain variable region
tcctatgtgctgactcagccaccctcggtgtcagtgtctccaggacagacggccaggatcacctgctctggcgatgcattcccaagacaatattcttattggtaccagcagaaggcaggccagccccctgtgttggtaatattgaaagactctgagaggccctcagggatccctgcgcgattctctggctccacctcagggacaacagtcaccttgaccatcactggagtccaggcagaagacgaggcagactattactgtcaatcatcggacagcagtggaaattatgtggtgttcggcggagggaccaagctcaccgtccta

SEQ ID NO: 1370 - protein, 108 aa, Artificial Sequence
  Description of Artificial Sequence: Synthetic light chain variable region
SYVLTQPPSVSVSPGQTARITCSGDAFPRQYSYWYQQKAGQPPVLVILKDSERPSGIPARFSGSTSGTTVTLTITGVQAEDEADYYCQSSDSSGNYVVFGGGTKLTVL

SEQ ID NO: 1371 - protein, 11 aa, Artificial Sequence
  Description of Artificial Sequence: Synthetic light chain variable region CDR L1
SGDAFPRQYSY

SEQ ID NO: 1372 - DNA, 33 bp, Artificial Sequence
  Description of Artificial Sequence: Synthetic light chain variable region CDR L1
tctggcgatgcattcccaagacaatattcttat

SEQ ID NO: 1373 - protein, 7 aa, Artificial Sequence
  Description of Artificial Sequence: Synthetic light chain variable region CDR L2
KDSERPS

SEQ ID NO: 1374 - DNA, 21 bp, Artificial Sequence
  Description of Artificial Sequence: Synthetic light chain variable region CDR L2
aaagactctgagaggccctca

SEQ ID NO: 1375 - protein, 11 aa, Artificial Sequence
  Description of Artificial Sequence: Synthetic light chain variable region CDR L3
QSSDSSGNYVV

SEQ ID NO: 1376 - DNA, 33 bp, Artificial Sequence
  Description of Artificial Sequence: Synthetic light chain variable region CDR L3
caatcatcggacagcagtggaaattatgtggtg

SEQ ID NO: 1377 - DNA, 384 bp, Artificial Sequence
  Description of Artificial Sequence: Synthetic heavy chain variable region
caggtccagcttgtgcagtctggggctgaattgaagaggcctgggtcatcggtgaaggtctcctgcaaggcttcaggggtctatttgacctcggttgctgtcaactgggtgcgacaggtccctggacatgggttcgagtggatgggtgggatactcactggctttggtaaagtcagacacgcccaggcctttgagaaccgtgccacgctcaccgcggacgcgtcgaccaacacagcctacttggagttgagcggacttcaagctgaagacacggccgcctattattgtgcgataatcgacccccaagattgtacggccgccagctgcttttgggtcaactggctcgacccctggggccagggaaccctggtcaccgtctcctca

SEQ ID NO: 1378 - protein, 128 aa, Artificial Sequence
  Description of Artificial Sequence: Synthetic heavy chain variable region
QVQLVQSGAELKRPGSSVKVSCKASGVYLTSVAVNWVRQVPGHGFEWMGGILTGFGKVRHAQAFENRATLTADASTNTAYLELSGLQAEDTAAYYCAIIDPQDCTAASCFWVNWLDPWGQGTLVTVSS

SEQ ID NO: 1379 - protein, 9 aa, Artificial Sequence
  Description of Artificial Sequence: Synthetic heavy chain variable region CDR H1
VYLTSVAVN

SEQ ID NO: 1380 - DNA, 27 bp, Artificial Sequence
  Description of Artificial Sequence: Synthetic heavy chain variable region CDR H1
gtctatttgacctcggttgctgtcaac

SEQ ID NO: 1381 - protein, 17 aa, Artificial Sequence
  Description of Artificial Sequence: Synthetic heavy chain variable region CDR H2
GILTGFGKVRHAQAFEN

SEQ ID NO: 1382 - DNA, 51 bp, Artificial Sequence
  Description of Artificial Sequence: Synthetic heavy chain variable region CDR H2
gggatactcactggctttggtaaagtcagacacgcccaggcctttgagaac

SEQ ID NO: 1383 - protein, 21 aa, Artificial Sequence
  Description of Artificial Sequence: Synthetic heavy chain variable region CDR H3
AIIDPQDCTAASCFWVNWLDP

SEQ ID NO: 1384 - DNA, 63 bp, Artificial Sequence
  Description of Artificial Sequence: Synthetic heavy chain variable region CDR H3
gcgataatcgacccccaagattgtacggccgccagctgcttttgggtcaactggctcgacccc

SEQ ID NO: 1385 - DNA, 324 bp, Artificial Sequence
  Description of Artificial Sequence: Synthetic light chain variable region
gaaattgtattgacacagtctccaggcaccctgaccgtgtctccaggggagagagccaccctctcctgcagggccagtcagagtgttcttagtagtcacttagcctggtaccagcagaaacctggccaggctcccaggctcctcatctatgctgcatccagtagggccactgacgtcccagacaggttcagtggcagtgggtctgggacagacttcactctcaccatcagcagactggagcctcaagattttgcagtctattactgtcagcagtatggttcctctccgatcaccttcggccaagggacacgactggagattaaa

SEQ ID NO: 1386 - protein, 108 aa, Artificial Sequence
  Description of Artificial Sequence: Synthetic light chain variable region
EIVLTQSPGTLTVSPGERATLSCRASQSVLSSHLAWYQQKPGQAPRLLIYAASSRATDVPDRFSGSGSGTDFTLTISRLEPQDFAVYYCQQYGSSPITFGQGTRLEIK

SEQ ID NO: 1387 - protein, 12 aa, Artificial Sequence
  Description of Artificial Sequence: Synthetic light chain variable region CDR L1
RASQSVLSSHLA

SEQ ID NO: 1388 - DNA, 36 bp, Artificial Sequence
  Description of Artificial Sequence: Synthetic light chain variable region CDR L1
agggccagtcagagtgttcttagtagtcacttagcc

SEQ ID NO: 1389 - protein, 7 aa, Artificial Sequence
  Description of Artificial Sequence: Synthetic light chain variable region CDR L2
AASSRAT

SEQ ID NO: 1390 - DNA, 21 bp, Artificial Sequence
  Description of Artificial Sequence: Synthetic light chain variable region CDR L2
gctgcatccagtagggccact

SEQ ID NO: 1391 - protein, 9 aa, Artificial Sequence
  Description of Artificial Sequence: Synthetic light chain variable region CDR L3
QQYGSSPIT

SEQ ID NO: 1392 - DNA, 27 bp, Artificial Sequence
  Description of Artificial Sequence: Synthetic light chain variable region CDR L3
cagcagtatggttcctctccgatcacc

SEQ ID NO: 1393 - DNA, 378 bp, Artificial Sequence
  Description of Artificial Sequence: Synthetic heavy chain variable region
caggtccagctggtgcagtctggggctgaggtgaagaagcctgggtcctcggtgaaggtctcctgtaaggttgccggaggttccttctccaattatgcaatcgcctggctgcgacaggcccctggacaagggcttgagtggatgggagggatcatacctgcctttaatagagcaatgtatgcacggaagttccaagacagagtcacaattaccgcgtacgcatcaacgaccactgcctacctggacattaccggcctcagatctgaggacacggccctttattattgtgcgaggcctgctggagactttggggatttaaagtgggtacgatcgccttttgactactggggccagggaaccctggtcaccgtctcctca

SEQ ID NO: 1394 - protein, 126 aa, Artificial Sequence
  Description of Artificial Sequence: Synthetic heavy chain variable region
QVQLVQSGAEVKKPGSSVKVSCKVAGGSFSNYAIAWLRQAPGQGLEWMGGIIPAFNRAMYARKFQDRVTITAYASTTTAYLDITGLRSEDTALYYCARPAGDFGDLKWVRSPFDYWGQGTLVTVSS

SEQ ID NO: 1395 - protein, 9 aa, Artificial Sequence
  Description of Artificial Sequence: Synthetic heavy chain variable region CDR H1
GSFSNYAIA

SEQ ID NO: 1396 - DNA, 27 bp, Artificial Sequence
  Description of Artificial Sequence: Synthetic heavy chain variable region CDR H1
ggttccttctccaattatgcaatcgcc

SEQ ID NO: 1397 - protein, 17 aa, Artificial Sequence
  Description of Artificial Sequence: Synthetic heavy chain variable region CDR H2
GIIPAFNRAMYARKFQD

SEQ ID NO: 1398 - DNA, 51 bp, Artificial Sequence
  Description of Artificial Sequence: Synthetic heavy chain variable region CDR H2
gggatcatacctgcctttaatagagcaatgtatgcacggaagttccaagac

SEQ ID NO: 1399 - protein, 19 aa, Artificial Sequence
  Description of Artificial Sequence: Synthetic heavy chain variable region CDR H3
ARPAGDFGDLKWVRSPFDY

SEQ ID NO: 1400 - DNA, 57 bp, Artificial Sequence; identical to SEQ ID NO: 1064
  Description of Artificial Sequence: Synthetic heavy chain variable region CDR H3

SEQ ID NO: 1401 - DNA, 327 bp, Artificial Sequence
  Description of Artificial Sequence: Synthetic light chain variable region
gaaacgacactcacgcagtctccaggcaccctgtctgtgtctccaggggaaagagccaccctctcctgcagggccagtcaggaagttggcatcaacttagcctggtatcagcagaaacctggccaggctcccaggctcctcatatatggtgcatccaccagggccactgatgtcccagccaggttcagtggcagtgggtctgggacagagttcactctcaccatcagcagcctgcagtctgaagattttgcagtttattattgtcaggagtataatgactggcctccccagctcactttcggccctgggaccaaagtggatatcaaa

SEQ ID NO: 1402 - protein, 109 aa, Artificial Sequence
  Description of Artificial Sequence: Synthetic light chain variable region
ETTLTQSPGTLSVSPGERATLSCRASQEVGINLAWYQQKPGQAPRLLIYGASTRATDVPARFSGSGSGTEFTLTISSLQSEDFAVYYCQEYNDWPPQLTFGPGTKVDIK

SEQ ID NO: 1403 - protein, 11 aa, Artificial Sequence
  Description of Artificial Sequence: Synthetic light chain variable region CDR L1
RASQEVGINLA

SEQ ID NO: 1404 - DNA, 33 bp, Artificial Sequence
  Description of Artificial Sequence: Synthetic light chain variable region CDR L1
agggccagtcaggaagttggcatcaacttagcc

SEQ ID NO: 1405 - protein, 7 aa, Artificial Sequence
  Description of Artificial Sequence: Synthetic light chain variable region CDR L2
GASTRAT

SEQ ID NO: 1406 - DNA, 21 bp, Artificial Sequence
  Description of Artificial Sequence: Synthetic light chain variable region CDR L2
ggtgcatccaccagggccact

SEQ ID NO: 1407 - protein, 11 aa, Artificial Sequence
  Description of Artificial Sequence: Synthetic light chain variable region CDR L3
QEYNDWPPQLT

SEQ ID NO: 1408 - DNA, 33 bp, Artificial Sequence
  Description of Artificial Sequence: Synthetic light chain variable region CDR L3
caggagtataatgactggcctccccagctcact

SEQ ID NO: 1409 - DNA, 384 bp, Artificial Sequence
  Description of Artificial Sequence: Synthetic heavy chain variable region
gaggtgcagctggtggagtctgggggaggcttggtaaagcctggggggtccctaagactctcatgtgcagcctctggattcatcttccgcaacgcctggatgagctgggtccgccaggctccagggaaggggctggagtgggttggccggattaaaaggacaagtgaaggtgggtcagtcgactacgcgacacccgtgcaaggcagattctccatctcaagagatgattctagaaacacgctgtatctgcaaatgaacagcctggaaaccgacgacacagccgtgtattactgttccacaggcccaccctattcttactttgatagtagtggttattcggtcgtggactactggggccagggaaccctggtcaccgtctcctca

SEQ ID NO: 1410 - protein, 128 aa, Artificial Sequence; identical to SEQ ID NO: 1314
  Description of Artificial Sequence: Synthetic heavy chain variable region

SEQ ID NO: 1411 - protein, 9 aa, Artificial Sequence
  Description of Artificial Sequence: Synthetic heavy chain variable region CDR H1
FIFRNAWMS

SEQ ID NO: 1412 - DNA, 27 bp, Artificial Sequence
  Description of Artificial Sequence: Synthetic heavy chain variable region CDR H1
ttcatcttccgcaacgcctggatgagc

SEQ ID NO: 1413 - protein, 19 aa, Artificial Sequence
  Description of Artificial Sequence: Synthetic heavy chain variable region CDR H2
RIKRTSEGGSVDYATPVQG

SEQ ID NO: 1414 - DNA, 57 bp, Artificial Sequence; identical to SEQ ID NO: 1318
  Description of Artificial Sequence: Synthetic heavy chain variable region CDR H2

SEQ ID NO: 1415 - protein, 19 aa, Artificial Sequence
  Description of Artificial Sequence: Synthetic heavy chain variable region CDR H3
STGPPYSYFDSSGYSVVDY

SEQ ID NO: 1416 - DNA, 57 bp, Artificial Sequence
  Description of Artificial Sequence: Synthetic heavy chain variable region CDR H3
tccacaggcccaccctattcttactttgatagtagtggttattcggtcgtggactac

SEQ ID NO: 1417 - DNA, 333 bp, Artificial Sequence
  Description of Artificial Sequence: Synthetic light chain variable region
cagtctgtcgtgacgcagccgccctcagtgtctgggacccccgggcagagggtcaccatctcctgcactgggagctcctccaacatcgggacaccttttgatgtacactggtaccagcagattccagagacagcccccaaactcatcatatctggtggtttcagtcggccctcaggggtccctgaccgattctctggctcccagtctggcacctctgcctccctggccatcagtgggctccggtccgaggatgaaggtgattattattgtgcagcttgggatgacagcctgagtggtccggtgttcggcggagggaccaagctcaccgtccta

SEQ ID NO: 1418 - protein, 111 aa, Artificial Sequence
  Description of Artificial Sequence: Synthetic light chain variable region
QSVVTQPPSVSGTPGQRVTISCTGSSSNIGTPFDVHWYQQIPETAPKLIISGGFSRPSGVPDRFSGSQSGTSASLAISGLRSEDEGDYYCAAWDDSLSGPVFGGGTKLTVL

SEQ ID NO: 1419 - protein, 14 aa, Artificial Sequence
  Description of Artificial Sequence: Synthetic light chain variable region CDR L1
TGSSSNIGTPFDVH

SEQ ID NO: 1420 - DNA, 42 bp, Artificial Sequence
  Description of Artificial Sequence: Synthetic light chain variable region CDR L1
actgggagctcctccaacatcgggacaccttttgatgtacac

SEQ ID NO: 1421 - protein, 7 aa, Artificial Sequence
  Description of Artificial Sequence: Synthetic light chain variable region CDR L2
GGFSRPS

SEQ ID NO: 1422 - DNA, 21 bp, Artificial Sequence
  Description of Artificial Sequence: Synthetic light chain variable region CDR L2
ggtggtttcagtcggccctca

SEQ ID NO: 1423 - protein, 11 aa, Artificial Sequence
  Description of Artificial Sequence: Synthetic light chain variable region CDR L3
AAWDDSLSGPV

SEQ ID NO: 1424 - DNA, 33 bp, Artificial Sequence; identical to SEQ ID NO: 208
  Description of Artificial Sequence: Synthetic light chain variable region CDR L3

SEQ ID NO: 1425 - DNA, 378 bp, Artificial Sequence
  Description of Artificial Sequence: Synthetic heavy chain variable region
caggtgcagctggtgcagtctggggctgaggtgaagaagcctgggtcctcggtgaaggtctcctgtaaggttgtcggaggcagtttcagcaactatgggattggctgggtgcgacaggcccctggacaagggcctgagtggatgggagggatcatccctgcctttaagacagcaaaatatgcaaagaagttccaggacagagtcacaattaccgcggacgaatcttcgagcactgcctacatggaggtgagaggcctcagacctgacgacacggccctgtattattgtgcgaggcctgaaggagactttggagatttgaagtgggtacgatcgccttttgactactggggccagggaaccctggtcaccgtctcctca

SEQ ID NO: 1426 - protein, 126 aa, Artificial Sequence
  Description of Artificial Sequence: Synthetic heavy chain variable region
QVQLVQSGAEVKKPGSSVKVSCKVVGGSFSNYGIGWVRQAPGQGPEWMGGIIPAFKTAKYAKKFQDRVTITADESSSTAYMEVRGLRPDDTALYYCARPEGDFGDLKWVRSPFDYWGQGTLVTVSS

SEQ ID NO: 1427 - protein, 9 aa, Artificial Sequence
  Description of Artificial Sequence: Synthetic heavy chain variable region CDR H1
GSFSNYGIG

SEQ ID NO: 1428 - DNA, 27 bp, Artificial Sequence
  Description of Artificial Sequence: Synthetic heavy chain variable region CDR H1
ggcagtttcagcaactatgggattggc

SEQ ID NO: 1429 - protein, 17 aa, Artificial Sequence
  Description of Artificial Sequence: Synthetic heavy chain variable region CDR H2
GIIPAFKTAKYAKKFQD

SEQ ID NO: 1430 - DNA, 51 bp, Artificial Sequence
  Description of Artificial Sequence: Synthetic heavy chain variable region CDR H2
gggatcatccctgcctttaagacagcaaaatatgcaaagaagttccaggac

SEQ ID NO: 1431 - protein, 19 aa, Artificial Sequence
  Description of Artificial Sequence: Synthetic heavy chain variable region CDR H3
ARPEGDFGDLKWVRSPFDY

SEQ ID NO: 1432 - DNA, 57 bp, Artificial Sequence
  Description of Artificial Sequence: Synthetic heavy chain variable region CDR H3
gcgaggcctgaaggagactttggagatttgaagtgggtacgatcgccttttgactac

SEQ ID NO: 1433 - DNA, 327 bp, Artificial Sequence
  Description of Artificial Sequence: Synthetic light chain variable region
gaaacgacactcacgcagtctccagccaccctgtctgtgtctccaggggaaagagtcaccctctcctgcagggccagtcaggatgttagcatcaacttagcctggtaccagcagaaacctggccaggctcccaggctcctcatctatggtgcatccaccagggccactgatgtcccagccaggttcagtggcagtgggtctgggacagacttcactctcaccatcagcagcctgcagtctgaagattttgcattttattattgtcaggagtataatgactggcctccccagctcactttcggccctgggaccaaggtggaaatcaaa

SEQ ID NO: 1434 - protein, 109 aa, Artificial Sequence
  Description of Artificial Sequence: Synthetic light chain variable region
ETTLTQSPATLSVSPGERVTLSCRASQDVSINLAWYQQKPGQAPRLLIYGASTRATDVPARFSGSGSGTDFTLTISSLQSEDFAFYYCQEYNDWPPQLTFGPGTKVEIK

SEQ ID NO: 1435 - protein, 11 aa, Artificial Sequence
  Description of Artificial Sequence: Synthetic light chain variable region CDR L1
RASQDVSINLA

SEQ ID NO: 1436 - DNA, 33 bp, Artificial Sequence
  Description of Artificial Sequence: Synthetic light chain variable region CDR L1
agggccagtcaggatgttagcatcaacttagcc

SEQ ID NO: 1437 - protein, 7 aa, Artificial Sequence
  Description of Artificial Sequence: Synthetic light chain variable region CDR L2
GASTRAT

SEQ ID NO: 1438 - DNA, 21 bp, Artificial Sequence
  Description of Artificial Sequence: Synthetic light chain variable region CDR L2
ggtgcatccaccagggccact

SEQ ID NO: 1439 - protein, 11 aa, Artificial Sequence
  Description of Artificial Sequence: Synthetic light chain variable region CDR L3
QEYNDWPPQLT

SEQ ID NO: 1440 - DNA, 33 bp, Artificial Sequence; identical to SEQ ID NO: 1408
  Description of Artificial Sequence: Synthetic light chain variable region CDR L3

SEQ ID NO: 1441 - DNA, 384 bp, Artificial Sequence
  Description of Artificial Sequence: Synthetic heavy chain variable region
caggtccagctggtgcagtctggggctgaggtgaagaagcctgggtcatcggtgaaggtctcctgcaaggcctcaggagtcattttgaccagcgttgctgtcagctgggtgcggcaggcccctggaaaaggctttgagtggatgggagggattcttcctggctttaataaagtcagacacgcccaggattttgagaacagagccactcacaccgcggacgcatctacgaacacagtctacatggagttgagcggactgaaatctgaggacacggccgtctattactgtgcgataatcgacccccaagattgtactcgtgccagttgcttttgggtcaactggctcgccccctggggccagggaaccctggtcaccgtctcctca

SEQ ID NO: 1442 - protein, 128 aa, Artificial Sequence
  Description of Artificial Sequence: Synthetic heavy chain variable region
QVQLVQSGAEVKKPGSSVKVSCKASGVILTSVAVSWVRQAPGKGFEWMGGILPGFNKVRHAQDFENRATHTADASTNTVYMELSGLKSEDTAVYYCAIIDPQDCTRASCFWVNWLAPWGQGTLVTVSS

SEQ ID NO: 1443 - protein, 9 aa, Artificial Sequence
  Description of Artificial Sequence: Synthetic heavy chain variable region CDR H1
VILTSVAVS

SEQ ID NO: 1444 - DNA, 27 bp, Artificial Sequence
  Description of Artificial Sequence: Synthetic heavy chain variable region CDR H1
gtcattttgaccagcgttgctgtcagc

SEQ ID NO: 1445 - protein, 17 aa, Artificial Sequence
  Description of Artificial Sequence: Synthetic heavy chain variable region CDR H2
GILPGFNKVRHAQDFEN

SEQ ID NO: 1446 - DNA, 51 bp, Artificial Sequence
  Description of Artificial Sequence: Synthetic heavy chain variable region CDR H2
gggattcttcctggctttaataaagtcagacacgcccaggattttgagaac

SEQ ID NO: 1447 - protein, 21 aa, Artificial Sequence
  Description of Artificial Sequence: Synthetic heavy chain variable region CDR H3
AIIDPQDCTRASCFWVNWLAP

SEQ ID NO: 1448 - DNA, 63 bp, Artificial Sequence; identical to SEQ ID NO: 1176
  Description of Artificial Sequence: Synthetic heavy chain variable region CDR H3

SEQ ID NO: 1449 - DNA, 324 bp, Artificial Sequence
  Description of Artificial Sequence: Synthetic light chain variable region
gaaacgacactcacgcagtctcccggcaccctgaccttgtctccaggggagagagccaccctgtcctgcagggccagtcagagtgttcctagcaggaacttagcctggtaccagcagaaacctggccaggctcccaggctcatcatctatgctgcatccaatagggccactgacatcccagacaggttcagtggcagtgggtctgggacagatttcactctcaccatcagcagactggagcctcaagattttgcagtgtattactgtcagcagtatgaaacctctccgatcaccttcggccaagggaccaaagtggatatcaaa

SEQ ID NO: 1450 - protein, 108 aa, Artificial Sequence
  Description of Artificial Sequence: Synthetic light chain variable region
ETTLTQSPGTLTLSPGERATLSCRASQSVPSRNLAWYQQKPGQAPRLIIYAASNRATDIPDRFSGSGSGTDFTLTISRLEPQDFAVYYCQQYETSPITFGQGTKVDIK

SEQ ID NO: 1451 - protein, 12 aa, Artificial Sequence
  Description of Artificial Sequence: Synthetic light chain variable region CDR L1
RASQSVPSRNLA

SEQ ID NO: 1452 - DNA, 36 bp, Artificial Sequence
  Description of Artificial Sequence: Synthetic light chain variable region CDR L1
agggccagtcagagtgttcctagcaggaacttagcc

SEQ ID NO: 1453 - protein, 7 aa, Artificial Sequence
  Description of Artificial Sequence: Synthetic light chain variable region CDR L2
AASNRAT

SEQ ID NO: 1454 - DNA, 21 bp, Artificial Sequence
  Description of Artificial Sequence: Synthetic light chain variable region CDR L2
gctgcatccaatagggccact

SEQ ID NO: 1455 - protein, 9 aa, Artificial Sequence
  Description of Artificial Sequence: Synthetic light chain variable region CDR L3
QQYETSPIT

SEQ ID NO: 1456 - DNA, 27 bp, Artificial Sequence
  Description of Artificial Sequence: Synthetic light chain variable region CDR L3
cagcagtatgaaacctctccgatcacc

SEQ ID NO: 1457 - DNA, 384 bp, Artificial Sequence
  Description of Artificial Sequence: Synthetic heavy chain variable region
gaggtgcagctggtggagtctgggggaggcttggtaaagcctggggggtccctaagactctcatgtgcagcctctggattcatcttccgcaacgcctggatgagctgggtccgccaggctccagggaaggggctggagtgggttggccggattaaaaggacaagtgaaggtgggtcagtcgactacgcgacacccgtgcaaggcagattctccatctcaagagatgattctagaaagacgctgtatctgcaaatgaacagcctggaaaccgacgacacagccgtgtattactgttccacaggcccaccctattcttactttgatagtagtggttattcggtcgtggactactggggcctgggaaccctggtcaccgtctcctca

SEQ ID NO: 1458 - protein, 128 aa, Artificial Sequence
  Description of Artificial Sequence: Synthetic heavy chain variable region
EVQLVESGGGLVKPGGSLRLSCAASGFIFRNAWMSWVRQAPGKGLEWVGRIKRTSEGGSVDYATPVQGRFSISRDDSRKTLYLQMNSLETDDTAVYYCSTGPPYSYFDSSGYSVVDYWGLGTLVTVSS

SEQ ID NO: 1459 - protein, 9 aa, Artificial Sequence
  Description of Artificial Sequence: Synthetic heavy chain variable region CDR H1
FIFRNAWMS

SEQ ID NO: 1460 - DNA, 27 bp, Artificial Sequence
  Description of Artificial Sequence: Synthetic heavy chain variable region CDR H1
ttcatcttccgcaacgcctggatgagc

SEQ ID NO: 1461 - protein, 19 aa, Artificial Sequence
  Description of Artificial Sequence: Synthetic heavy chain variable region CDR H2
RIKRTSEGGSVDYATPVQG

SEQ ID NO: 1462 - DNA, 57 bp, Artificial Sequence; identical to SEQ ID NO: 1318
  Description of Artificial Sequence: Synthetic heavy chain variable region CDR H2

SEQ ID NO: 1463 - protein, 19 aa, Artificial Sequence
  Description of Artificial Sequence: Synthetic heavy chain variable region CDR H3
STGPPYSYFDSSGYSVVDY

SEQ ID NO: 1464 - DNA, 57 bp, Artificial Sequence; identical to SEQ ID NO: 1416
  Description of Artificial Sequence: Synthetic heavy chain variable region CDR H3

SEQ ID NO: 1465 - DNA, 330 bp, Artificial Sequence
  Description of Artificial Sequence: Synthetic light chain variable region
tcctatgagctgactcagccaccctcagcgtctgggacccccgggcagagggtcaccatctcttgttctgcaagcagctccaacatcggagataattatttctactggtaccaacaactcccaggaaaggcccccacactcctcatgtatggtagtgatcaacggtcctcaggggtccctgaccgattctctggctcccagtctggcacctctgcctccctggccatcagtgggctccggtccgaggatgaagctgattattattgtgcagcttgggatgacagcctgagtggtccggtgttcggcggaggcacccagctgaccgtcctc

SEQ ID NO: 1466 - protein, 110 aa, Artificial Sequence
  Description of Artificial Sequence: Synthetic light chain variable region
SYELTQPPSASGTPGQRVTISCSASSSNIGDNYFYWYQQLPGKAPTLLMYGSDQRSSGVPDRFSGSQSGTSASLAISGLRSEDEADYYCAAWDDSLSGPVFGGGTQLTVL

SEQ ID NO: 1467 - protein, 13 aa, Artificial Sequence
  Description of Artificial Sequence: Synthetic light chain variable region CDR L1
SASSSNIGDNYFY

SEQ ID NO: 1468 - DNA, 39 bp, Artificial Sequence; identical to SEQ ID NO: 204
  Description of Artificial Sequence: Synthetic light chain variable region CDR L1

SEQ ID NO: 1469 - protein, 7 aa, Artificial Sequence
  Description of Artificial Sequence: Synthetic light chain variable region CDR L2
GSDQRSS

SEQ ID NO: 1470 - DNA, 21 bp, Artificial Sequence
  Description of Artificial Sequence: Synthetic light chain variable region CDR L2
ggtagtgatcaacggtcctca

SEQ ID NO: 1471 - protein, 11 aa, Artificial Sequence
  Description of Artificial Sequence: Synthetic light chain variable region CDR L3
AAWDDSLSGPV

SEQ ID NO: 1472 - DNA, 33 bp, Artificial Sequence; identical to SEQ ID NO: 208
  Description of Artificial Sequence: Synthetic light chain variable region CDR L3

SEQ ID NO: 1473 - DNA, 387 bp, Artificial Sequence
  Description of Artificial Sequence: Synthetic heavy chain variable region
caggtccagctggtgcagtctggggctgaggtgaagaagcctgggtcctcggtgataatctcctgcaaggcatctggaggcaccttcagaaactacggtttcacctgggtgcgacaggcccctggacaagggcttgagtggttgggagggatcatccctatgtttgagacagtcagatatgcacagaagttccagggaagagtcacaatcaccgcggacgaaaacaccaacacagccttcctggcggtgagcagcctgcgatctgaagacacgggcgtctatttttgtgcgcgagacctccagacggggattatgagcagcgtgaggtcggaatataggggctttatggacccctggggccagggaaccctggtcaccgtctcctca

SEQ ID NO: 1474 - protein, 129 aa, Artificial Sequence
  Description of Artificial Sequence: Synthetic heavy chain variable region
QVQLVQSGAEVKKPGSSVIISCKASGGTFRNYGFTWVRQAPGQGLEWLGGIIPMFETVRYAQKFQGRVTITADENTNTAFLAVSSLRSEDTGVYFCARDLQTGIMSSVRSEYRGFMDPWGQGTLVTVSS

SEQ ID NO: 1475 - protein, 9 aa, Artificial Sequence
  Description of Artificial Sequence: Synthetic heavy chain variable region CDR H1
GTFRNYGFT

SEQ ID NO: 1476 - DNA, 27 bp, Artificial Sequence
  Description of Artificial Sequence: Synthetic heavy chain variable region CDR H1
ggcaccttcagaaactacggtttcacc

SEQ ID NO: 1477 - protein, 17 aa, Artificial Sequence
  Description of Artificial Sequence: Synthetic heavy chain variable region CDR H2
GIIPMFETVRYAQKFQG

SEQ ID NO: 1478 - DNA, 51 bp, Artificial Sequence
  Description of Artificial Sequence: Synthetic heavy chain variable region CDR H2
gggatcatccctatgtttgagacagtcagatatgcacagaagttccaggga

SEQ ID NO: 1479 - protein, 22 aa, Artificial Sequence
  Description of Artificial Sequence: Synthetic heavy chain variable region CDR H3
ARDLQTGIMSSVRSEYRGFMDP

SEQ ID NO: 1480 - DNA, 66 bp, Artificial Sequence
  Description of Artificial Sequence: Synthetic heavy chain variable region CDR H3
gcgcgagacctccagacggggattatgagcagcgtgaggtcggaatataggggctttatggacccc

SEQ ID NO: 1481 - DNA, 330 bp, Artificial Sequence
  Description of Artificial Sequence: Synthetic light chain variable region
cagtctgtgctgacgcagccgccctcggtgtctggagccccccggcagagggtcaccatctcctgttctggaagcagctccaacatcggaactaatgctgtaaactggtaccaacagctcccaggaaagtctcccaaagtcctcatctactatgatgagctggtgccctcaggggtctctgaccgattctctggctccaggtctggcacctcagcctccctggccataagtggactccggtctgaggatgaggcttactattactgtgcagcttgggatgacagtctgaatggttgggtgttcggcggaggcacccagctcaccgtccta

SEQ ID NO: 1482 - protein, 110 aa, Artificial Sequence
  Description of Artificial Sequence: Synthetic light chain variable region
QSVLTQPPSVSGAPRQRVTISCSGSSSNIGTNAVNWYQQLPGKSPKVLIYYDELVPSGVSDRFSGSRSGTSASLAISGLRSEDEAYYYCAAWDDSLNGWVFGGGTQLTVL

SEQ ID NO: 1483 - protein, 13 aa, Artificial Sequence
  Description of Artificial Sequence: Synthetic light chain variable region CDR L1
SGSSSNIGTNAVN

SEQ ID NO: 1484 - DNA, 39 bp, Artificial Sequence
  Description of Artificial Sequence: Synthetic light chain variable region CDR L1
tctggaagcagctccaacatcggaactaatgctgtaaac

SEQ ID NO: 1485 - protein, 7 aa, Artificial Sequence
  Description of Artificial Sequence: Synthetic light chain variable region CDR L2
YDELVPS

SEQ ID NO: 1486 - DNA, 21 bp, Artificial Sequence
  Description of Artificial Sequence: Synthetic light chain variable region CDR L2
tatgatgagctggtgccctca

SEQ ID NO: 1487 - protein, 11 aa, Artificial Sequence
  Description of Artificial Sequence: Synthetic light chain variable region CDR L3
AAWDDSLNGWV

SEQ ID NO: 1488 - DNA, 33 bp, Artificial Sequence
  Description of Artificial Sequence: Synthetic light chain variable region CDR L3
gcagcttgggatgacagtctgaatggttgggtg

SEQ ID NO: 1489 - DNA, 366 bp, Artificial Sequence
  Description of Artificial Sequence: Synthetic heavy chain variable region
gaggtgcagctggtggagtcggggggaggcgtggtccagcctgggaggtccctgagactctcctgtgcagtctctggattcacgttcagtaactttgggatgcactgggtccgccaggctccaggcaaggggctggagtgggtggcagctatttcatacgatggaagaaaaagattccaggcagactccgtgaagggccgattcaccatctccagagacaacttgaagaacacgctgaatctccaaatgaacagcctgaaaactgaggacacggctgtgtattactgtgcgaaatcgtctagacttttggactggttatacaatatggacttctggggccaagggaccacggtcaccgtctcctca

SEQ ID NO: 1490 - protein, 122 aa, Artificial Sequence
  Description of Artificial Sequence: Synthetic heavy chain variable region
EVQLVESGGGVVQPGRSLRLSCAVSGFTFSNFGMHWVRQAPGKGLEWVAAISYDGRKRFQADSVKGRFTISRDNLKNTLNLQMNSLKTEDTAVYYCAKSSRLLDWLYNMDFWGQGTTVTVSS

SEQ ID NO: 1491 - protein, 9 aa, Artificial Sequence
  Description of Artificial Sequence: Synthetic heavy chain variable region CDR H1
FTFSNFGMH

SEQ ID NO: 1492 - DNA, 27 bp, Artificial Sequence
  Description of Artificial Sequence: Synthetic heavy chain variable region CDR H1
ttcacgttcagtaactttgggatgcac

SEQ ID NO: 1493 - protein, 17 aa, Artificial Sequence
  Description of Artificial Sequence: Synthetic heavy chain variable region CDR H2
AISYDGRKRFQADSVKG

SEQ ID NO: 1494 - DNA, 51 bp, Artificial Sequence
  Description of Artificial Sequence: Synthetic heavy chain variable region CDR H2
gctatttcatacgatggaagaaaaagattccaggcagactccgtgaagggc

SEQ ID NO: 1495 - protein, 15 aa, Artificial Sequence
  Description of Artificial Sequence: Synthetic heavy chain variable region CDR H3
AKSSRLLDWLYNMDF

SEQ ID NO: 1496 - DNA, 45 bp, Artificial Sequence
  Description of Artificial Sequence: Synthetic heavy chain variable region CDR H3
gcgaaatcgtctagacttttggactggttatacaatatggacttc

SEQ ID NO: 1497 - DNA, 324 bp, Artificial Sequence
  Description of Artificial Sequence: Synthetic light chain variable region
tcctatgtgctgactcagccaccctcagtgtcagtggccccaggaaagacggccaggattacctgtgggggaaacatccttgggagttcaagtgtccactggttccagcagaaggcaggccaggcccctgtcctggtcatctattatgatagcgaccggccctcagggatccctgagcgattctctggctcccattctggggacacggccaccctgaccatcagcagggtcgaagtcggggatgaggccgactattactgtcaggtgtgggataatagtaattcccagggggtcttcggcggaggcacccagctgaccgtcctc

SEQ ID NO: 1498 - protein, 108 aa, Artificial Sequence
  Description of Artificial Sequence: Synthetic light chain variable region
SYVLTQPPSVSVAPGKTARITCGGNILGSSSVHWFQQKAGQAPVLVIYYDSDRPSGIPERFSGSHSGDTATLTISRVEVGDEADYYCQVWDNSNSQGVFGGGTQLTVL

SEQ ID NO: 1499 - protein, 11 aa, Artificial Sequence
  Description of Artificial Sequence: Synthetic light chain variable region CDR L1
GGNILGSSSVH

SEQ ID NO: 1500 - DNA, 33 bp, Artificial Sequence
  Description of Artificial Sequence: Synthetic light chain variable region CDR L1
gggggaaacatccttgggagttcaagtgtccac

SEQ ID NO: 1501 - protein, 7 aa, Artificial Sequence
  Description of Artificial Sequence: Synthetic light chain variable region CDR L2
YDSDRPS

SEQ ID NO: 1502 - DNA, 21 bp, Artificial Sequence
  Description of Artificial Sequence: Synthetic light chain variable region CDR L2
tatgatagcgaccggccctca

SEQ ID NO: 1503 - protein, 11 aa, Artificial Sequence
  Description of Artificial Sequence: Synthetic light chain variable region CDR L3
QVWDNSNSQGV

SEQ ID NO: 1504 - DNA, 33 bp, Artificial Sequence
  Description of Artificial Sequence: Synthetic light chain variable region CDR L3
caggtgtgggataatagtaattcccagggggtc

SEQ ID NO: 1505 - DNA, 369 bp, Artificial Sequence
  Description of Artificial Sequence: Synthetic heavy chain variable region
caggtgcagctacagcagtggggcccaggactggtgaagccgtcacagaccctgtccctcacctgcagtgtctctggtgcctcagtcaaaataggttctaatttctggacgtggatccgccagcgcccagggaagggcctggagtggattggggccatccatgacactggcaccacctactacaacccgtcccttgagcctcaagtaatcatttcaactgacacgtctcagaaccaattctccctgaggctgacctctgtgactgccgcggacacggccgtttactactgtgcgagggggcgtggatacacctatggatggcgttactttgactactggggccagggaaccctggtcaccgtctcctca

SEQ ID NO: 1506 - protein, 123 aa, Artificial Sequence
  Description of Artificial Sequence: Synthetic heavy chain variable region
QVQLQQWGPGLVKPSQTLSLTCSVSGASVKIGSNFWTWIRQRPGKGLEWIGAIHDTGTTYYNPSLEPQVIISTDTSQNQFSLRLTSVTAADTAVYYCARGRGYTYGWRYFDYWGQGTLVTVSS

SEQ ID NO: 1507 - protein, 11 aa, Artificial Sequence
  Description of Artificial Sequence: Synthetic heavy chain variable region CDR H1
ASVKIGSNFWT

SEQ ID NO: 1508 - DNA, 33 bp, Artificial Sequence
  Description of Artificial Sequence: Synthetic heavy chain variable region CDR H1
gcctcagtcaaaataggttctaatttctggacg

SEQ ID NO: 1509 - protein, 16 aa, Artificial Sequence
  Description of Artificial Sequence: Synthetic heavy chain variable region CDR H2
AIHDTGTTYYNPSLEP

SEQ ID NO: 1510 - DNA, 48 bp, Artificial Sequence
  Description of Artificial Sequence: Synthetic heavy chain variable region CDR H2
gccatccatgacactggcaccacctactacaacccgtcccttgagcct

SEQ ID NO: 1511 - protein, 15 aa, Artificial Sequence
  Description of Artificial Sequence: Synthetic heavy chain variable region CDR H3
ARGRGYTYGWRYFDY

SEQ ID NO: 1512 - DNA, 45 bp, Artificial Sequence
  Description of Artificial Sequence: Synthetic heavy chain variable region CDR H3
gcgagggggcgtggatacacctatggatggcgttactttgactac

SEQ ID NO: 1513 - DNA, 324 bp, Artificial Sequence
  Description of Artificial Sequence: Synthetic light chain variable region
tcctatgtgctgactcagccaccctcggtgtcagtgtccccaggacagacggccaggatcacctgctctggagatgcattgccaaagcaatatgccttttggtatcagcacaaggcaggacaggcccctgtgttggtcataaaaaaagacactgagaggccctcagggatccctgagcgattctctggctccatctcagggacaacagccactttgatcatcagtggagtccaggcagaagacgaggctgactattactgtcaatcttcagacagtagtggtaatgttgtcttattcggcggaggcacccagctgaccgtcctc

SEQ ID NO: 1514 - protein, 108 aa, Artificial Sequence
  Description of Artificial Sequence: Synthetic light chain variable region
SYVLTQPPSVSVSPGQTARITCSGDALPKQYAFWYQHKAGQAPVLVIKKDTERPSGIPERFSGSISGTTATLIISGVQAEDEADYYCQSSDSSGNVVLFGGGTQLTVL

SEQ ID NO: 1515 - protein, 11 aa, Artificial Sequence
  Description of Artificial Sequence: Synthetic light chain variable region CDR L1
SGDALPKQYAF

SEQ ID NO: 1516 - DNA, 33 bp, Artificial Sequence
  Description of Artificial Sequence: Synthetic light chain variable region CDR L1
tctggagatgcattgccaaagcaatatgccttt

SEQ ID NO: 1517 - protein, 7 aa, Artificial Sequence
  Description of Artificial Sequence: Synthetic light chain variable region CDR L2
KDTERPS

SEQ ID NO: 1518 - DNA, 21 bp, Artificial Sequence
  Description of Artificial Sequence: Synthetic light chain variable region CDR L2
aaagacactgagaggccctca

SEQ ID NO: 1519 - protein, 11 aa, Artificial Sequence
  Description of Artificial Sequence: Synthetic light chain variable region CDR L3
QSSDSSGNVVL

SEQ ID NO: 1520 - DNA, 33 bp, Artificial Sequence
  Description of Artificial Sequence: Synthetic light chain variable region CDR L3
caatcttcagacagtagtggtaatgttgtctta

SEQ ID NO: 1521 - DNA, 372 bp, Artificial Sequence
  Description of Artificial Sequence: Synthetic heavy chain variable region
caggtgcagctggtgcaatctgggggaggcgtggtccagcctgggaggtccctgagactctcctgtgcagcgtctggattcagcttcagtagttatggcatgcactgggtccgccaggctccaggcaaggggctggagtgggtggcagctatattttatcatgaaattaaggactattatgcagactccgtgaacggccgattcagcatctccagagacaattccaagaacaccctgtatctggaaatgtacagcctgaaggtcgaggacacggctgtgtattattgtgcgagagatagtgggaccctcacaggactcccgcatgatgcctttgatatctggggccaagggaccacggtcaccgtctcctca

SEQ ID NO: 1522 - protein, 124 aa, Artificial Sequence
  Description of Artificial Sequence: Synthetic heavy chain variable region
QVQLVQSGGGVVQPGRSLRLSCAASGFSFSSYGMHWVRQAPGKGLEWVAAIFYHEIKDYYADSVNGRFSISRDNSKNTLYLEMYSLKVEDTAVYYCARDSGTLTGLPHDAFDIWGQGTTVTVSS

SEQ ID NO: 1523 - protein, 9 aa, Artificial Sequence
  Description of Artificial Sequence: Synthetic heavy chain variable region CDR H1
FSFSSYGMH

SEQ ID NO: 1524 - DNA, 27 bp, Artificial Sequence
  Description of Artificial Sequence: Synthetic heavy chain variable region CDR H1
ttcagcttcagtagttatggcatgcac

SEQ ID NO: 1525 - protein, 17 aa, Artificial Sequence
  Description of Artificial Sequence: Synthetic heavy chain variable region CDR H2
AIFYHEIKDYYADSVNG

SEQ ID NO: 1526 - DNA, 51 bp, Artificial Sequence
  Description of Artificial Sequence: Synthetic heavy chain variable region CDR H2
gctatattttatcatgaaattaaggactattatgcagactccgtgaacggc

SEQ ID NO: 1527 - protein, 17 aa, Artificial Sequence
  Description of Artificial Sequence: Synthetic heavy chain variable region CDR H3
ARDSGTLTGLPHDAFDI

SEQ ID NO: 1528 - DNA, 51 bp, Artificial Sequence
  Description of Artificial Sequence: Synthetic heavy chain variable region CDR H3
gcgagagatagtgggaccctcacaggactcccgcatgatgcctttgatatc

SEQ ID NO: 1529 - DNA, 321 bp, Artificial Sequence
  Description of Artificial Sequence: Synthetic light chain variable region
gacatccagatgacccagtctccttccaccctgagtgcatctttaggaggcagagtcaccatcacttgccgggccagtcagagtgttactaacaggttggcctggtatcaacacaaaccagggaaagcccctaacctcctgatctataaggcgtctactttagaaatcggggtcccatcaaggttcagcggcagtggatctgggacagagttcactctcaccatcagcagcctgcagcctgatgattttgcgacttattactgccaacagtatagtagttattcgtggacgttcggccaagggaccaaggtggaaatcaaa

SEQ ID NO: 1530 - protein, 107 aa, Artificial Sequence
  Description of Artificial Sequence: Synthetic light chain variable region
DIQMTQSPSTLSASLGGRVTITCRASQSVTNRLAWYQHKPGKAPNLLIYKASTLEIGVPSRFSGSGSGTEFTLTISSLQPDDFATYYCQQYSSYSWTFGQGTKVEIK

SEQ ID NO: 1531 - protein, 11 aa, Artificial Sequence
  Description of Artificial Sequence: Synthetic light chain variable region CDR L1
RASQSVTNRLA

SEQ ID NO: 1532 - DNA, 33 bp, Artificial Sequence
  Description of Artificial Sequence: Synthetic light chain variable region CDR L1
cgggccagtcagagtgttactaacaggttggcc

SEQ ID NO: 1533 - protein, 7 aa, Artificial Sequence
  Description of Artificial Sequence: Synthetic light chain variable region CDR L2
KASTLEI

SEQ ID NO: 1534 - DNA, 21 bp, Artificial Sequence
  Description of Artificial Sequence: Synthetic light chain variable region CDR L2
aaggcgtctactttagaaatc

SEQ ID NO: 1535 - protein, 9 aa, Artificial Sequence
  Description of Artificial Sequence: Synthetic light chain variable region CDR L3
QQYSSYSWT

SEQ ID NO: 1536 - DNA, 27 bp, Artificial Sequence
  Description of Artificial Sequence: Synthetic light chain variable region CDR L3
caacagtatagtagttattcgtggacg

SEQ ID NO: 1537 - DNA, 384 bp, Artificial Sequence; identical to SEQ ID NO: 1457
  Description of Artificial Sequence: Synthetic heavy chain variable region

SEQ ID NO: 1538 - protein, 128 aa, Artificial Sequence; identical to SEQ ID NO: 1458
  Description of Artificial Sequence: Synthetic heavy chain variable region

SEQ ID NO: 1539 - protein, 9 aa, Artificial Sequence
  Description of Artificial Sequence: Synthetic heavy chain variable region CDR H1
FIFRNAWMS

SEQ ID NO: 1540 - DNA, 27 bp, Artificial Sequence
  Description of Artificial Sequence: Synthetic heavy chain variable region CDR H1
ttcatcttccgcaacgcctggatgagc

SEQ ID NO: 1541 - protein, 19 aa, Artificial Sequence
  Description of Artificial Sequence: Synthetic heavy chain variable region CDR H2
RIKRTSEGGSVDYATPVQG

SEQ ID NO: 1542 - DNA, 57 bp, Artificial Sequence; identical to SEQ ID NO: 1318
  Description of Artificial Sequence: Synthetic heavy chain variable region CDR H2

SEQ ID NO: 1543 - protein, 19 aa, Artificial Sequence
  Description of Artificial Sequence: Synthetic heavy chain variable region CDR H3
STGPPYSYFDSSGYSVVDY

SEQ ID NO: 1544 - DNA, 57 bp, Artificial Sequence; identical to SEQ ID NO: 1416
  Description of Artificial Sequence: Synthetic heavy chain variable region CDR H3

SEQ ID NO: 1545 - DNA, 330 bp, Artificial Sequence
  Description of Artificial Sequence: Synthetic light chain variable region
cagccagtgctgactcagcccccctcagcgtctgggacccccgggcagagggtcaccatctcttgttctgcaagcagctccaacatcggagataattatttctactggtaccaacaactcccaggaaaggcccccacactcctcatgtatggtagtgatcaacggtcctcaggggtccctgaccgattctctggctcccagtctggcacctctgcctccctggccatcagtgggctccggtccgaggatgaagctgattattattgtgcagcttgggatgacagcctgagtggtccggtgttcggcggagggaccaagctcaccgtccta

SEQ ID NO: 1546 - protein, 110 aa, Artificial Sequence
  Description of Artificial Sequence: Synthetic light chain variable region
QPVLTQPPSASGTPGQRVTISCSASSSNIGDNYFYWYQQLPGKAPTLLMYGSDQRSSGVPDRFSGSQSGTSASLAISGLRSEDEADYYCAAWDDSLSGPVFGGGTKLTVL

SEQ ID NO: 1547 - protein, 13 aa, Artificial Sequence
  Description of Artificial Sequence: Synthetic light chain variable region CDR L1
SASSSNIGDNYFY

SEQ ID NO: 1548 - DNA, 39 bp, Artificial Sequence; identical to SEQ ID NO: 204
  Description of Artificial Sequence: Synthetic light chain variable region CDR L1

SEQ ID NO: 1549 - protein, 7 aa, Artificial Sequence
  Description of Artificial Sequence: Synthetic light chain variable region CDR L2
GSDQRSS

SEQ ID NO: 1550 - DNA, 21 bp, Artificial Sequence
  Description of Artificial Sequence: Synthetic light chain variable region CDR L2
ggtagtgatcaacggtcctca

SEQ ID NO: 1551 - protein, 11 aa, Artificial Sequence
  Description of Artificial Sequence: Synthetic light chain variable region CDR L3
AAWDDSLSGPV

SEQ ID NO: 1552 - DNA, 33 bp, Artificial Sequence; identical to SEQ ID NO: 208
  Description of Artificial Sequence: Synthetic light chain variable region CDR L3

SEQ ID NO: 1553 - DNA, 366 bp, Artificial Sequence
  Description of Artificial Sequence: Synthetic heavy chain variable region
gaggtgcagctggtggagtcggggggaggcgtggtccagcctgggaggtccctgagactctcctgtgcagtctctggattcacattcagtaactttgggatgcactgggtccgccaggctccaggcaaggggctggagtgggtggcagctatttcatacgatggaagaaaaacattccaggcagactccgtgaagggccgattcatcatctccagagacaacttgaagaacacgttgaatctccaaatgaacagcctgaaaactgaggacacggctgtgtattactgtgcgaaatcgtctagatttttggactggttatacaatatggacttctggggccaagggaccacggtcaccgtctcctca

SEQ ID NO: 1554 - protein, 122 aa, Artificial Sequence
  Description of Artificial Sequence: Synthetic heavy chain variable region
EVQLVESGGGVVQPGRSLRLSCAVSGFTFSNFGMHWVRQAPGKGLEWVAAISYDGRKTFQADSVKGRFIISRDNLKNTLNLQMNSLKTEDTAVYYCAKSSRFLDWLYNMDFWGQGTTVTVSS

SEQ ID NO: 1555 - protein, 9 aa, Artificial Sequence
  Description of Artificial Sequence: Synthetic heavy chain variable region CDR H1
FTFSNFGMH

SEQ ID NO: 1556 - DNA, 27 bp, Artificial Sequence
  Description of Artificial Sequence: Synthetic heavy chain variable region CDR H1
ttcacattcagtaactttgggatgcac

SEQ ID NO: 1557 - protein, 17 aa, Artificial Sequence
  Description of Artificial Sequence: Synthetic heavy chain variable region CDR H2
AISYDGRKTFQADSVKG

SEQ ID NO: 1558 - DNA, 51 bp, Artificial Sequence
  Description of Artificial Sequence: Synthetic heavy chain variable region CDR H2
gctatttcatacgatggaagaaaaacattccaggcagactccgtgaagggc

SEQ ID NO: 1559 - protein, 15 aa, Artificial Sequence
  Description of Artificial Sequence: Synthetic heavy chain variable region CDR H3
AKSSRFLDWLYNMDF

SEQ ID NO: 1560 - DNA, 45 bp, Artificial Sequence
  Description of Artificial Sequence: Synthetic heavy chain variable region CDR H3
gcgaaatcgtctagatttttggactggttatacaatatggacttc

SEQ ID NO: 1561 - DNA, 324 bp, Artificial Sequence
  Description of Artificial Sequence: Synthetic light chain variable region
tcctatgagctgacacagccaccctcagtgtcagaggccccaggaaagacggccacgattacctgtgggggaatcatccttgggacttcaagtgtccactggttccagcagaagtcaggccaggcccctgtcctggtcatctattatgatagcgaccggccctcagggatccctgagcgattctctggctcccattctggggacacggccaccctgaccatcagcagggtcgaagtcggggatgaggccgactattactgtcaggtgtgggataatagtcattcccagggggtcttcggcggaggcacccagctgaccgtcctc

SEQ ID NO: 1562 - protein, 108 aa, Artificial Sequence
  Description of Artificial Sequence: Synthetic light chain variable region
SYELTQPPSVSEAPGKTATITCGGIILGTSSVHWFQQKSGQAPVLVIYYDSDRPSGIPERFSGSHSGDTATLTISRVEVGDEADYYCQVWDNSHSQGVFGGGTQLTVL

SEQ ID NO: 1563 - protein, 11 aa, Artificial Sequence
  Description of Artificial Sequence: Synthetic light chain variable region CDR L1
GGIILGTSSVH

SEQ ID NO: 1564 - DNA, 33 bp, Artificial Sequence
  Description of Artificial Sequence: Synthetic light chain variable region CDR L1
gggggaatcatccttgggacttcaagtgtccac

SEQ ID NO: 1565 - protein, 7 aa, Artificial Sequence
  Description of Artificial Sequence: Synthetic light chain variable region CDR L2
YDSDRPS

SEQ ID NO: 1566 - DNA, 21 bp, Artificial Sequence
  Description of Artificial Sequence: Synthetic light chain variable region CDR L2
tatgatagcgaccggccctca

SEQ ID NO: 1567 - protein, 11 aa, Artificial Sequence
  Description of Artificial Sequence: Synthetic light chain variable region CDR L3
QVWDNSHSQGV

SEQ ID NO: 1568 - DNA, 33 bp, Artificial Sequence
  Description of Artificial Sequence: Synthetic light chain variable region CDR L3
caggtgtgggataatagtcattcccagggggtc

SEQ ID NO: 1569 - DNA, 372 bp, Artificial Sequence
  Description of Artificial Sequence: Synthetic heavy chain variable region
caggtgcagctggtggagtctgggggaggcgtggtccagcctgggaggtccctgagactctcctgtgcagcgtctggattcgccttccgtgtctatgacatccactgggtccgccaggctccaggcaaggggctggagtgggtggcagttgcctggtctgatggacgtgatgaattctatgcagactccgtgaagggccgaatcaccatctccagagacaattcaaagaacactgtatatctgcagatgagcagcctgagagtcgcggatacggctgtgtattactgtgcgagagatagtgggaccctaacagggctccctcatgatgcttttgatgtctggggccaggggaccacggtcaccgtctcctca

SEQ ID NO: 1570 - protein, 124 aa, Artificial Sequence
  Description of Artificial Sequence: Synthetic heavy chain variable region
QVQLVESGGGVVQPGRSLRLSCAASGFAFRVYDIHWVRQAPGKGLEWVAVAWSDGRDEFYADSVKGRITISRDNSKNTVYLQMSSLRVADTAVYYCARDSGTLTGLPHDAFDVWGQGTTVTVSS

SEQ ID NO: 1571 - protein, 9 aa, Artificial Sequence
  Description of Artificial Sequence: Synthetic heavy chain variable region CDR H1
FAFRVYDIH

SEQ ID NO: 1572 - DNA, 27 bp, Artificial Sequence
  Description of Artificial Sequence: Synthetic heavy chain variable region CDR H1
ttcgccttccgtgtctatgacatccac

SEQ ID NO: 1573 - protein, 17 aa, Artificial Sequence
  Description of Artificial Sequence: Synthetic heavy chain variable region CDR H2
VAWSDGRDEFYADSVKG

SEQ ID NO: 1574 - DNA, 51 bp, Artificial Sequence
  Description of Artificial Sequence: Synthetic heavy chain variable region CDR H2
gttgcctggtctgatggacgtgatgaattctatgcagactccgtgaagggc

SEQ ID NO: 1575 - protein, 17 aa, Artificial Sequence
  Description of Artificial Sequence: Synthetic heavy chain variable region CDR H3
ARDSGTLTGLPHDAFDV

SEQ ID NO: 1576 - DNA, 51 bp, Artificial Sequence
  Description of Artificial Sequence: Synthetic heavy chain variable region CDR H3
gcgagagatagtgggaccctaacagggctccctcatgatgcttttgatgtc

SEQ ID NO: 1577 - DNA, 321 bp, Artificial Sequence
  Description of Artificial Sequence: Synthetic light chain variable region
gacatccagttgacccagtctccttccaccctgtctgcatctgtaggagacagagtcaccatcacttgccgggccagtcagagtattaccaccaggttggcctggtatcagcagaaattagggaaagcccctaagctcctggtctataaggcgtcaactttagaaattggggtcccctcaaggttcagcggcaggggatctgggacagaattcactctcaccatcagcagcctgcagcctgatgattttgcaacttattactgccatcactacaatagttattcgtggacgttcggccaagggaccaaagtggatatcaaa

SEQ ID NO: 1578 - protein, 107 aa, Artificial Sequence
  Description of Artificial Sequence: Synthetic light chain variable region
DIQLTQSPSTLSASVGDRVTITCRASQSITTRLAWYQQKLGKAPKLLVYKASTLEIGVPSRFSGRGSGTEFTLTISSLQPDDFATYYCHHYNSYSWTFGQGTKVDIK

SEQ ID NO: 1579 - protein, 11 aa, Artificial Sequence
  Description of Artificial Sequence: Synthetic light chain variable region CDR L1
RASQSITTRLA

SEQ ID NO: 1580 - DNA, 33 bp, Artificial Sequence
  Description of Artificial Sequence: Synthetic light chain variable region CDR L1
cgggccagtcagagtattaccaccaggttggcc

SEQ ID NO: 1581 - protein, 7 aa, Artificial Sequence
  Description of Artificial Sequence: Synthetic light chain variable region CDR L2
KASTLEI

SEQ ID NO: 1582 - DNA, 21 bp, Artificial Sequence
  Description of Artificial Sequence: Synthetic light chain variable region CDR L2
aaggcgtcaactttagaaatt

SEQ ID NO: 1583 - protein, 9 aa, Artificial Sequence
  Description of Artificial Sequence: Synthetic light chain variable region CDR L3
HHYNSYSWT

SEQ ID NO: 1584 - DNA, 27 bp, Artificial Sequence
  Description of Artificial Sequence: Synthetic light chain variable region CDR L3
catcactacaatagttattcgtggacg

SEQ ID NO: 1585 - DNA, 372 bp, Artificial Sequence
  Description of Artificial Sequence: Synthetic heavy chain variable region
caggtgcagctggtggagtctgggggaggcgtggtccagcctgggaggtccctgagactctcctgtgctgcctctggattcactttcactgactatgctatgcactgggtccgccaggctccaggcaagggactacagtgggtggcacttatatcatataacggacgtatacaatattacgcagactccgtgaagggccgattcaccatctccagagacgattccaagaacacgctgtatctgcagatgaacagcctgagagctggggacacggctgtctattactgtgcgagagatggggatcttgtggctgtcccagctgctatcggcttcgactcctggggccagggaaccctggtcaccgtctcctca

SEQ ID NO: 1586 - protein, 124 aa, Artificial Sequence
  Description of Artificial Sequence: Synthetic heavy chain variable region
QVQLVESGGGVVQPGRSLRLSCAASGFTFTDYAMHWVRQAPGKGLQWVALISYNGRIQYYADSVKGRFTISRDDSKNTLYLQMNSLRAGDTAVYYCARDGDLVAVPAAIGFDSWGQGTLVTVSS

SEQ ID NO: 1587 - protein, 9 aa, Artificial Sequence
  Description of Artificial Sequence: Synthetic heavy chain variable region CDR H1
FTFTDYAMH

SEQ ID NO: 1588 - DNA, 27 bp, Artificial Sequence
  Description of Artificial Sequence: Synthetic heavy chain variable region CDR H1
ttcactttcactgactatgctatgcac

SEQ ID NO: 1589 - protein, 17 aa, Artificial Sequence
  Description of Artificial Sequence: Synthetic heavy chain variable region CDR H2
LISYNGRIQYYADSVKG

SEQ ID NO: 1590 - DNA, 51 bp, Artificial Sequence
  Description of Artificial Sequence: Synthetic heavy chain variable region CDR H2
cttatatcatataacggacgtatacaatattacgcagactccgtgaagggc

SEQ ID NO: 1591 - protein, 17 aa, Artificial Sequence
  Description of Artificial Sequence: Synthetic heavy chain variable region CDR H3
ARDGDLVAVPAAIGFDS

SEQ ID NO: 1592 - DNA, 51 bp, Artificial Sequence
  Description of Artificial Sequence: Synthetic heavy chain variable region CDR H3
gcgagagatggggatcttgtggctgtcccagctgctatcggcttcgactcc

SEQ ID NO: 1593 - DNA, 339 bp, Artificial Sequence
  Description of Artificial Sequence: Synthetic light chain variable region
gacatccaggtgacccagtctccagactccctggctgtgtctctgggcgagagggccaccatcaactgcaagtccagccagagtgttttatacacctccaacaacaagaactacttagcttggtaccagcagaaatcgagacagcctcctaagctgctcatttactgggcatctacccgggaatccggggtccctgagcgattcagtggcagcgggtctgggacagatttcactctcaccatcagcagcctgcaggctgaagatgtggcagtttattactgtcagcaatattctagtcctccgtacacttttggccaggggaccaaggtggagattaaa

SEQ ID NO: 1594 - protein, 113 aa, Artificial Sequence
  Description of Artificial Sequence: Synthetic light chain variable region
DIQVTQSPDSLAVSLGERATINCKSSQSVLYTSNNKNYLAWYQQKSRQPPKLLIYWASTRESGVPERFSGSGSGTDFTLTISSLQAEDVAVYYCQQYSSPPYTFGQGTKVEIK

SEQ ID NO: 1595 - protein, 17 aa, Artificial Sequence
  Description of Artificial Sequence: Synthetic light chain variable region CDR L1
KSSQSVLYTSNNKNYLA

SEQ ID NO: 1596 - DNA, 51 bp, Artificial Sequence
  Description of Artificial Sequence: Synthetic light chain variable region CDR L1
aagtccagccagagtgttttatacacctccaacaacaagaactacttagct

SEQ ID NO: 1597 - protein, 7 aa, Artificial Sequence
  Description of Artificial Sequence: Synthetic light chain variable region CDR L2
WASTRES

SEQ ID NO: 1598 - DNA, 21 bp, Artificial Sequence
  Description of Artificial Sequence: Synthetic light chain variable region CDR L2
tgggcatctacccgggaatcc

SEQ ID NO: 1599 - protein, 9 aa, Artificial Sequence
  Description of Artificial Sequence: Synthetic light chain variable region CDR L3
QQYSSPPYT

SEQ ID NO: 1600 - DNA, 27 bp, Artificial Sequence
  Description of Artificial Sequence: Synthetic light chain variable region CDR L3
cagcaatattctagtcctccgtacact

SEQ ID NO: 1601 - DNA, 366 bp, Artificial Sequence
  Description of Artificial Sequence: Synthetic heavy chain variable region
gaggtgcagctggtggagtctgggggaggcctggtcaggccgggggggtccctgagactctcctgcgcagcgtctggattcgccttcagtagctatagtttacactgggtccgccaggctccagggaggggactggagtgggtcgcatcgatcagtgcaggtagcagtttcacagattacgcggcctcagtgaggggccgattcactatctccagaaacatcgccaactcactgtatctgcaaatgaacaggctgagagccgaggacacggctgtctattactgtgcgagagttatcggagacgggacgattcttggagtggtttttgactactggggcccgggaaccctggtcaccgtctcctca

SEQ ID NO: 1602 - protein, 122 aa, Artificial Sequence
  Description of Artificial Sequence: Synthetic heavy chain variable region
EVQLVESGGGLVRPGGSLRLSCAASGFAFSSYSLHWVRQAPGRGLEWVASISAGSSFTDYAASVRGRFTISRNIANSLYLQMNRLRAEDTAVYYCARVIGDGTILGVVFDYWGPGTLVTVSS

SEQ ID NO: 1603 - protein, 9 aa, Artificial Sequence
  Description of Artificial Sequence: Synthetic heavy chain variable region CDR H1
FAFSSYSLH

SEQ ID NO: 1604 - DNA, 27 bp, Artificial Sequence
  Description of Artificial Sequence: Synthetic heavy chain variable region CDR H1
ttcgccttcagtagctatagtttacac

SEQ ID NO: 1605 - protein, 17 aa, Artificial Sequence
  Description of Artificial Sequence: Synthetic heavy chain variable region CDR H2
SISAGSSFTDYAASVRG

SEQ ID NO: 1606 - DNA, 51 bp, Artificial Sequence
  Description of Artificial Sequence: Synthetic heavy chain variable region CDR H2
tcgatcagtgcaggtagcagtttcacagattacgcggcctcagtgaggggc

SEQ ID NO: 1607 - protein, 16 aa, Artificial Sequence
  Description of Artificial Sequence: Synthetic heavy chain variable region CDR H3
ARVIGDGTILGVVFDY

SEQ ID NO: 1608 - DNA, 48 bp, Artificial Sequence
  Description of Artificial Sequence: Synthetic heavy chain variable region CDR H3
gcgagagttatcggagacgggacgattcttggagtggtttttgactac

SEQ ID NO: 1609 - DNA, 330 bp, Artificial Sequence
  Description of Artificial Sequence: Synthetic light chain variable region
cagtctgtcctgacgcagccgccctcagtgtctggggccccagggcagagggtcaccatctcctgcactgggggcaggtccaacatcggggccggttatgatgtacactggtaccagcaacttccagggacagcccccaaactcctcatctatggtaacatcaatcggccctcaggggtccctgaccgattctctggctccaagtctggcacctcagcctccctggccatcactgggctcctggctgaggatgaggctgattattactgccagtcctatgacagcagcctgagtgtgattttcggcggagggaccaagctcaccgtccta

SEQ ID NO: 1610 - protein, 110 aa, Artificial Sequence
  Description of Artificial Sequence: Synthetic light chain variable region
QSVLTQPPSVSGAPGQRVTISCTGGRSNIGAGYDVHWYQQLPGTAPKLLIYGNINRPSGVPDRFSGSKSGTSASLAITGLLAEDEADYYCQSYDSSLSVIFGGGTKLTVL

SEQ ID NO: 1611 - protein, 14 aa, Artificial Sequence
  Description of Artificial Sequence: Synthetic light chain variable region CDR L1
TGGRSNIGAGYDVH

SEQ ID NO: 1612 - DNA, 42 bp, Artificial Sequence
  Description of Artificial Sequence: Synthetic light chain variable region CDR L1
actgggggcaggtccaacatcggggccggttatgatgtacac

SEQ ID NO: 1613 - protein, 7 aa, Artificial Sequence
  Description of Artificial Sequence: Synthetic light chain variable region CDR L2
GNINRPS

SEQ ID NO: 1614 - DNA, 21 bp, Artificial Sequence
  Description of Artificial Sequence: Synthetic light chain variable region CDR L2
ggtaacatcaatcggccctca

SEQ ID NO: 1615 - protein, 10 aa, Artificial Sequence
  Description of Artificial Sequence: Synthetic light chain variable region CDR L3
QSYDSSLSVI

SEQ ID NO: 1616 - DNA, 30 bp, Artificial Sequence
  Description of Artificial Sequence: Synthetic light chain variable region CDR L3
cagtcctatgacagcagcctgagtgtgatt

SEQ ID NO: 1617 - DNA, 372 bp, Artificial Sequence
  Description of Artificial Sequence: Synthetic heavy chain variable region
caggtccagctggtgcagtctggagcagaggtgaaaaagcccggggagtctctgaagatctcctgtaagggttctggatacgtctttagtagttactgggtcgcctgggtgcgccagatgcccgggaaaggcctggagtggatggggatcatctatcctcatgactctgataccagatacagcccggccttccaaggccaggtcaccatttcagccgataagtccatcaacaccgcctacctgcagtggagcagcctgaaggcctcggacaccgccatgtattactgcaccattatactaataccagctcctatacgggcccctgatggttttgatatctggggccaagggaccacggtcaccgtctcctca

SEQ ID NO: 1618 - protein, 124 aa, Artificial Sequence
  Description of Artificial Sequence: Synthetic heavy chain variable region
QVQLVQSGAEVKKPGESLKISCKGSGYVFSSYWVAWVRQMPGKGLEWMGIIYPHDSDTRYSPAFQGQVTISADKSINTAYLQWSSLKASDTAMYYCTIILIPAPIRAPDGFDIWGQGTTVTVSS

SEQ ID NO: 1619 - protein, 9 aa, Artificial Sequence
  Description of Artificial Sequence: Synthetic heavy chain variable region CDR H1
YVFSSYWVA

SEQ ID NO: 1620 - DNA, 27 bp, Artificial Sequence
  Description of Artificial Sequence: Synthetic heavy chain variable region CDR H1
tacgtctttagtagttactgggtcgcc

SEQ ID NO: 1621 - protein, 17 aa, Artificial Sequence
  Description of Artificial Sequence: Synthetic heavy chain variable region CDR H2
IIYPHDSDTRYSPAFQG

SEQ ID NO: 1622 - DNA, 51 bp, Artificial Sequence
  Description of Artificial Sequence: Synthetic heavy chain variable region CDR H2
atcatctatcctcatgactctgataccagatacagcccggccttccaaggc

SEQ ID NO: 1623 - protein, 17 aa, Artificial Sequence
  Description of Artificial Sequence: Synthetic heavy chain variable region CDR H3
TIILIPAPIRAPDGFDI

SEQ ID NO: 1624 - DNA, 51 bp, Artificial Sequence
  Description of Artificial Sequence: Synthetic heavy chain variable region CDR H3
accattatactaataccagctcctatacgggcccctgatggttttgatatc

SEQ ID NO: 1625 - DNA, 333 bp, Artificial Sequence
  Description of Artificial Sequence: Synthetic light chain variable region
aattttatgctgactcagccccactctgtgtcggagtctccggggaagacggtaaccatctcctgcaccggcagcggtggcaccattgccagcaactatgtgcagtggtaccagcagcgcccgggcagtgtccccaccactgtgatctatgagaataacgaaagaccctctggggtccctgatcggttctctggctccatcgacaggtcctccaactctgcctccctcaccatctctggactgaagactgaggacgaggctgactactactgtcagtcttatgatagcagctatcatgtggtattcggcggagggaccaaggtcaccgtccta

SEQ ID NO: 1626 - protein, 111 aa, Artificial Sequence
  Description of Artificial Sequence: Synthetic light chain variable region
NFMLTQPHSVSESPGKTVTISCTGSGGTIASNYVQWYQQRPGSVPTTVIYENNERPSGVPDRFSGSIDRSSNSASLTISGLKTEDEADYYCQSYDSSYHVVFGGGTKVTVL

SEQ ID NO: 1627 - protein, 13 aa, Artificial Sequence
  Description of Artificial Sequence: Synthetic light chain variable region CDR L1
TGSGGTIASNYVQ

SEQ ID NO: 1628 - DNA, 39 bp, Artificial Sequence
  Description of Artificial Sequence: Synthetic light chain variable region CDR L1
accggcagcggtggcaccattgccagcaactatgtgcag

SEQ ID NO: 1629 - protein, 7 aa, Artificial Sequence
  Description of Artificial Sequence: Synthetic light chain variable region CDR L2
ENNERPS

SEQ ID NO: 1630 - DNA, 21 bp, Artificial Sequence
  Description of Artificial Sequence: Synthetic light chain variable region CDR L2
gagaataacgaaagaccctct

SEQ ID NO: 1631 - protein, 10 aa, Artificial Sequence
  Description of Artificial Sequence: Synthetic light chain variable region CDR L3
QSYDSSYHVV

SEQ ID NO: 1632 - DNA, 30 bp, Artificial Sequence
  Description of Artificial Sequence: Synthetic light chain variable region CDR L3
cagtcttatgatagcagctatcatgtggta

SEQ ID NO: 1633 - DNA, 369 bp, Artificial Sequence
  Description of Artificial Sequence: Synthetic heavy chain variable region
caggtgcagctggtgcagtctggggctgaggtgaagaagcctgggtcctcggtgaaggtctcctgcaaggcctctggagacacgttcagcagctatgctatcagctgggtgcgacaggcccctggacaaggacttgagtggatgggaggggtcctccctatgttagggacagcaaactacgcacagaggttccggggcagagtcacacttaccgcggacggatccacgaacacagcctacatggagatgagcagcctgagacttgacgacacggccgtgtattactgtgcgagagtggccggtctgggaaatagctacggtcgataccctgacctctggggccagggaaccctggtcaccgtctcctca

SEQ ID NO: 1634 - protein, 123 aa, Artificial Sequence
  Description of Artificial Sequence: Synthetic heavy chain variable region
QVQLVQSGAEVKKPGSSVKVSCKASGDTFSSYAISWVRQAPGQGLEWMGGVLPMLGTANYAQRFRGRVTLTADGSTNTAYMEMSSLRLDDTAVYYCARVAGLGNSYGRYPDLWGQGTLVTVSS

SEQ ID NO: 1635 - protein, 9 aa, Artificial Sequence
  Description of Artificial Sequence: Synthetic heavy chain variable region CDR H1
DTFSSYAIS

SEQ ID NO: 1636 - DNA, 27 bp, Artificial Sequence
  Description of Artificial Sequence: Synthetic heavy chain variable region CDR H1
gacacgttcagcagctatgctatcagc

SEQ ID NO: 1637 - protein, 17 aa, Artificial Sequence
  Description of Artificial Sequence: Synthetic heavy chain variable region CDR H2
GVLPMLGTANYAQRFRG

SEQ ID NO: 1638 - DNA, 51 bp, Artificial Sequence
  Description of Artificial Sequence: Synthetic heavy chain variable region CDR H2
ggggtcctccctatgttagggacagcaaactacgcacagaggttccggggc

SEQ ID NO: 1639 - protein, 16 aa, Artificial Sequence
  Description of Artificial Sequence: Synthetic heavy chain variable region CDR H3
ARVAGLGNSYGRYPDL

SEQ ID NO: 1640 - DNA, 48 bp, Artificial Sequence
  Description of Artificial Sequence: Synthetic heavy chain variable region CDR H3
gcgagagtggccggtctgggaaatagctacggtcgataccctgacctc

SEQ ID NO: 1641 - DNA, 321 bp, Artificial Sequence
  Description of Artificial Sequence: Synthetic light chain variable region
gatattgtgatgacccagtctccatcttctctgtctgcatctgttggagacagagtcaccatcacttgtcgggcgagtcagggtattagcagctcgttagcctggtatcagcagaaaccagggaaagcccctgagctcctgatctatgctgcatccagtttgcacagtggggtcccatcgaggttccggggcagtggatctgggacagacttcactctcactatcagcagcgtgcagcctgaagattttgcaacttactattgtcaacaggcaaacagtttcccgtacacttttggccaggggaccaagctggagatcaaa

SEQ ID NO: 1642 - protein, 107 aa, Artificial Sequence
  Description of Artificial Sequence: Synthetic light chain variable region
DIVMTQSPSSLSASVGDRVTITCRASQGISSSLAWYQQKPGKAPELLIYAASSLHSGVPSRFRGSGSGTDFTLTISSVQPEDFATYYCQQANSFPYTFGQGTKLEIK

SEQ ID NO: 1643 - protein, 11 aa, Artificial Sequence
  Description of Artificial Sequence: Synthetic light chain variable region CDR L1
RASQGISSSLA

SEQ ID NO: 1644 - DNA, 33 bp, Artificial Sequence
  Description of Artificial Sequence: Synthetic light chain variable region CDR L1
cgggcgagtcagggtattagcagctcgttagcc

SEQ ID NO: 1645 - protein, 7 aa, Artificial Sequence
  Description of Artificial Sequence: Synthetic light chain variable region CDR L2
AASSLHS

SEQ ID NO: 1646 - DNA, 21 bp, Artificial Sequence
  Description of Artificial Sequence: Synthetic light chain variable region CDR L2
gctgcatccagtttgcacagt

SEQ ID NO: 1647 - protein, 9 aa, Artificial Sequence
  Description of Artificial Sequence: Synthetic light chain variable region CDR L3
QQANSFPYT

SEQ ID NO: 1648 - DNA, 27 bp, Artificial Sequence
  Description of Artificial Sequence: Synthetic light chain variable region CDR L3
caacaggcaaacagtttcccgtacact

SEQ ID NO: 1649 - DNA, 363 bp, Artificial Sequence
  Description of Artificial Sequence: Synthetic heavy chain variable region
caggtccagcttgtacagtctggagcagaggtgaaaaagccgggggagtctctgaagatctcctgtaagggtgcaggattcggctctaccaactcctggatcggctgggtgcgccagatgcccgggaaaggcctggagtggatgggggtcatctttccaggtgactctgataccaaatacagcccgaccttccaaggccaggtcaccatctcagtcgacaagtccatcaacaccgcctacctgcagtggagcagcctgaaggcctcggacaccgccatctattactgtgcgagaatgctggcttctgttggtttgtccaactttgacgcgtggggccagggaaccctggtcaccgtctcctca

SEQ ID NO: 1650 - protein, 121 aa, Artificial Sequence
  Description of Artificial Sequence: Synthetic heavy chain variable region
QVQLVQSGAEVKKPGESLKISCKGAGFGSTNSWIGWVRQMPGKGLEWMGVIFPGDSDTKYSPTFQGQVTISVDKSINTAYLQWSSLKASDTAIYYCARMLASVGLSNFDAWGQGTLVTVSS

SEQ ID NO: 1651 - protein, 9 aa, Artificial Sequence
  Description of Artificial Sequence: Synthetic heavy chain variable region CDR H1
FGSTNSWIG

SEQ ID NO: 1652 - DNA, 27 bp, Artificial Sequence
  Description of Artificial Sequence: Synthetic heavy chain variable region CDR H1
ttcggctctaccaactcctggatcggc

SEQ ID NO: 1653 - protein, 17 aa, Artificial Sequence
  Description of Artificial Sequence: Synthetic heavy chain variable region CDR H2
VIFPGDSDTKYSPTFQG

SEQ ID NO: 1654 - DNA, 51 bp, Artificial Sequence
  Description of Artificial Sequence: Synthetic heavy chain variable region CDR H2
gtcatctttccaggtgactctgataccaaatacagcccgaccttccaaggc

SEQ ID NO: 1655 - protein, 14 aa, Artificial Sequence
  Description of Artificial Sequence: Synthetic heavy chain variable region CDR H3
ARMLASVGLSNFDA

SEQ ID NO: 1656 - DNA, 42 bp, Artificial Sequence
  Description of Artificial Sequence: Synthetic heavy chain variable region CDR H3
gcgagaatgctggcttctgttggtttgtccaactttgacgcg

SEQ ID NO: 1657 - DNA, 324 bp, Artificial Sequence
  Description of Artificial Sequence: Synthetic light chain variable region
cagcctgtgctgactcagccaccctcagtgtcactggccccaggaaagacggccacgattacctgtgggggaaacaacattggaggtaaaagtgtgcactggtaccagcagaagccaggccaggcccctgtgctggtcatcgattatgatagcgaccggccctcagggatccctgagcgattctctggctccaactctgggaacacggccaccctgaccatcaacagggtcgaagccggggatgaggccgactactactgtcaggtgtgggatagtattagtgatcatgtgttattcggtggagggaccaagctgaccgtccta

SEQ ID NO: 1658 - protein, 108 aa, Artificial Sequence
  Description of Artificial Sequence: Synthetic light chain variable region
QPVLTQPPSVSLAPGKTATITCGGNNIGGKSVHWYQQKPGQAPVLVIDYDSDRPSGIPERFSGSNSGNTATLTINRVEAGDEADYYCQVWDSISDHVLFGGGTKLTVL

SEQ ID NO: 1659 - protein, 11 aa, Artificial Sequence
  Description of Artificial Sequence: Synthetic light chain variable region CDR L1
GGNNIGGKSVH

SEQ ID NO: 1660 - DNA, 33 bp, Artificial Sequence
  Description of Artificial Sequence: Synthetic light chain variable region CDR L1
gggggaaacaacattggaggtaaaagtgtgcac

SEQ ID NO: 1661 - protein, 7 aa, Artificial Sequence
  Description of Artificial Sequence: Synthetic light chain variable region CDR L2
YDSDRPS

SEQ ID NO: 1662 - DNA, 21 bp, Artificial Sequence
  Description of Artificial Sequence: Synthetic light chain variable region CDR L2
tatgatagcgaccggccctca

SEQ ID NO: 1663 - protein, 11 aa, Artificial Sequence
  Description of Artificial Sequence: Synthetic light chain variable region CDR L3
QVWDSISDHVL

SEQ ID NO: 1664 - DNA, 33 bp, Artificial Sequence
  Description of Artificial Sequence: Synthetic light chain variable region CDR L3
caggtgtgggatagtattagtgatcatgtgtta

SEQ ID NO: 1665 - DNA, 390 bp, Artificial Sequence
  Description of Artificial Sequence: Synthetic heavy chain variable region
gaggtgcagctggtggagtctgggggaggcttggttaagcctggggggtcccttagactctcttgtgcagcctctggattcactttcagtaacgcctggatgagctgggtccgccaggctccagggaaggggctggagtgggttggccgtgttaaaagcaaatctaaaggtgggacaacacactacgctgaagccgtgaagggcagattcaccatttcaagagatgattcaaaaaacacgctgtacctccaaatgcagagcctgaaaaccgaggacacagccgtctattactgtacctcccacgcgtataatagtgactggttcgtgacgactgactactactactacatggacgtctggggcaaagggaccacggtcaccgtctcctca

SEQ ID NO: 1666 - protein, 130 aa, Artificial Sequence
  Description of Artificial Sequence: Synthetic heavy chain variable region
EVQLVESGGGLVKPGGSLRLSCAASGFTFSNAWMSWVRQAPGKGLEWVGRVKSKSKGGTTHYAEAVKGRFTISRDDSKNTLYLQMQSLKTEDTAVYYCTSHAYNSDWFVTTDYYYYMDVWGKGTTVTVSS

SEQ ID NO: 1667 - protein, 9 aa, Artificial Sequence
  Description of Artificial Sequence: Synthetic heavy chain variable region CDR H1
FTFSNAWMS

SEQ ID NO: 1668 - DNA, 27 bp, Artificial Sequence
  Description of Artificial Sequence: Synthetic heavy chain variable region CDR H1
ttcactttcagtaacgcctggatgagc

SEQ ID NO: 1669 - protein, 19 aa, Artificial Sequence
  Description of Artificial Sequence: Synthetic heavy chain variable region CDR H2
RVKSKSKGGTTHYAEAVKG

SEQ ID NO: 1670 - DNA, 57 bp, Artificial Sequence
  Description of Artificial Sequence: Synthetic heavy chain variable region CDR H2
cgtgttaaaagcaaatctaaaggtgggacaacacactacgctgaagccgtgaagggc

SEQ ID NO: 1671 - protein, 21 aa, Artificial Sequence
  Description of Artificial Sequence: Synthetic heavy chain variable region CDR H3
TSHAYNSDWFVTTDYYYYMDV

SEQ ID NO: 1672 - DNA, 63 bp, Artificial Sequence
  Description of Artificial Sequence: Synthetic heavy chain variable region CDR H3
acctcccacgcgtataatagtgactggttcgtgacgactgactactactactacatggacgtc

SEQ ID NO: 1673 - DNA, 321 bp, Artificial Sequence
  Description of Artificial Sequence: Synthetic light chain variable region
gatattgtgctgacccagtctccatcctccctgtctgcatctgttggagacagagtcaccttcacttgccgggcaagtcagagcattagcaactatttgaattggtatcagcagaaaccagggaaagcccctaaggtcctgatctatggtgcttccaatttgctaagtggggtcccatcaaggttcattggcagcggatctgggacagatttcactctcaccatcaacagtctgcaacctgaagattttgcaacttactactgtcaacagtgttacagtgccccgatcaccttcggccaagggacacgactggagattaaa

SEQ ID NO: 1674 - protein, 107 aa, Artificial Sequence
  Description of Artificial Sequence: Synthetic light chain variable region
DIVLTQSPSSLSASVGDRVTFTCRASQSISNYLNWYQQKPGKAPKVLIYGASNLLSGVPSRFIGSGSGTDFTLTINSLQPEDFATYYCQQCYSAPITFGQGTRLEIK

SEQ ID NO: 1675 - protein, 11 aa, Artificial Sequence
  Description of Artificial Sequence: Synthetic light chain variable region CDR L1
RASQSISNYLN

SEQ ID NO: 1676 - DNA, 33 bp, Artificial Sequence
  Description of Artificial Sequence: Synthetic light chain variable region CDR L1
cgggcaagtcagagcattagcaactatttgaat

SEQ ID NO: 1677 - protein, 7 aa, Artificial Sequence
  Description of Artificial Sequence: Synthetic light chain variable region CDR L2
GASNLLS

SEQ ID NO: 1678 - DNA, 21 bp, Artificial Sequence
  Description of Artificial Sequence: Synthetic light chain variable region CDR L2
ggtgcttccaatttgctaagt

SEQ ID NO: 1679 - protein, 9 aa, Artificial Sequence
  Description of Artificial Sequence: Synthetic light chain variable region CDR L3
QQCYSAPIT

SEQ ID NO: 1680 - DNA, 27 bp, Artificial Sequence
  Description of Artificial Sequence: Synthetic light chain variable region CDR L3
caacagtgttacagtgccccgatcacc

SEQ ID NO: 1681 - DNA, 390 bp, Artificial Sequence
  Description of Artificial Sequence: Synthetic heavy chain variable region
caggtccagctggtgcagtctggggctgaggtgaagaagcctgggtcctcggtgaaggtctcctgcacggcctctggaggcagcttcagcaccaatagtattgcctggctgaggcagacccctagagaagggctggagtggatgggaggaatcatccctgtctttggtgcagcaaaatacgcacagaagttccagggcagagtcacgattagcgcggacgcatccacgaccacagcctacttggagctgcacaacctgagatctgaggacactgccgtctattactgcgcgagaggaatttcccccaggacaaacagtgactggaaccacaactacttctactactacatggacgtctggggcaaagggaccacggtcaccgtctcctca

SEQ ID NO: 1682 - protein, 130 aa, Artificial Sequence
  Description of Artificial Sequence: Synthetic heavy chain variable region
QVQLVQSGAEVKKPGSSVKVSCTASGGSFSTNSIAWLRQTPREGLEWMGGIIPVFGAAKYAQKFQGRVTISADASTTTAYLELHNLRSEDTAVYYCARGISPRTNSDWNHNYFYYYMDVWGKGTTVTVSS

SEQ ID NO: 1683 - protein, 9 aa, Artificial Sequence
  Description of Artificial Sequence: Synthetic heavy chain variable region CDR H1
GSFSTNSIA

SEQ ID NO: 1684 - DNA, 27 bp, Artificial Sequence
  Description of Artificial Sequence: Synthetic heavy chain variable region CDR H1
ggcagcttcagcaccaatagtattgcc

SEQ ID NO: 1685 - protein, 17 aa, Artificial Sequence
  Description of Artificial Sequence: Synthetic heavy chain variable region CDR H2
GIIPVFGAAKYAQKFQG

SEQ ID NO: 1686 - DNA, 51 bp, Artificial Sequence
  Description of Artificial Sequence: Synthetic heavy chain variable region CDR H2
ggaatcatccctgtctttggtgcagcaaaatacgcacagaagttccagggc

SEQ ID NO: 1687 - protein, 23 aa, Artificial Sequence
  Description of Artificial Sequence: Synthetic heavy chain variable region CDR H3
ARGISPRTNSDWNHNYFYYYMDV

SEQ ID NO: 1688 - DNA, 69 bp, Artificial Sequence
  Description of Artificial Sequence: Synthetic heavy chain variable region CDR H3
gcgagaggaatttcccccaggacaaacagtgactggaaccacaactacttctactactacatggacgtc

SEQ ID NO: 1689 - DNA, 324 bp, Artificial Sequence
  Description of Artificial Sequence: Synthetic light chain variable region
gaaacgacactcacgcagtctccaggcaccctgtctttgtctccaggggagagagccaccctctcctgccgggccagtcagagtattttcaccatctacttagcctggtaccagcagaaacctggccaggctcccagactcctcatctatagtgcatccaacagggccactggcatcccagacaggttcagtggcagtgggtctgggacagacttcactctcaccatcagcagcctggagcctgaagattttgcagtctattactgccaccactatggtacctcacctcacacttttggccaggggacacgactggagattaaa

SEQ ID NO: 1690 - protein, 108 aa, Artificial Sequence
  Description of Artificial Sequence: Synthetic light chain variable region
ETTLTQSPGTLSLSPGERATLSCRASQSIFTIYLAWYQQKPGQAPRLLIYSASNRATGIPDRFSGSGSGTDFTLTISSLEPEDFAVYYCHHYGTSPHTFGQGTRLEIK

SEQ ID NO: 1691 - protein, 12 aa, Artificial Sequence
  Description of Artificial Sequence: Synthetic light chain variable region CDR L1
RASQSIFTIYLA

SEQ ID NO: 1692 - DNA, 36 bp, Artificial Sequence
  Description of Artificial Sequence: Synthetic light chain variable region CDR L1
cgggccagtcagagtattttcaccatctacttagcc

SEQ ID NO: 1693 - protein, 7 aa, Artificial Sequence
  Description of Artificial Sequence: Synthetic light chain variable region CDR L2
SASNRAT

SEQ ID NO: 1694 - DNA, 21 bp, Artificial Sequence
  Description of Artificial Sequence: Synthetic light chain variable region CDR L2
agtgcatccaacagggccact

SEQ ID NO: 1695 - protein, 9 aa, Artificial Sequence
  Description of Artificial Sequence: Synthetic light chain variable region CDR L3
HHYGTSPHT

SEQ ID NO: 1696 - DNA, 27 bp, Artificial Sequence
  Description of Artificial Sequence: Synthetic light chain variable region CDR L3
caccactatggtacctcacctcacact

SEQ ID NO: 1697 - DNA, 360 bp, Artificial Sequence
  Description of Artificial Sequence: Synthetic heavy chain variable region
gaggtgcagctgttggagtctggtcctgtgctggtgaaacccacagagaccctcacgctgacctgcaccgtctctgggttctcactcgccaatcctgacgtggctgtggcctggatccgtcagccccccgggaaggccctggagtggcttgcacacattttttcgggcgacgaaacatcctacaccacatctctgcagaacagactcaccatctccaaggacacctccaaaagccaggttgtccttatcatgaccaagatggaccctcgagacaccggcacatatttctgtgcacgggtgttgactacctggcacggaccggactactggggccaggggaccacggtcaccgtctcctca

SEQ ID NO: 1698 - protein, 120 aa, Artificial Sequence
  Description of Artificial Sequence: Synthetic heavy chain variable region
EVQLLESGPVLVKPTETLTLTCTVSGFSLANPDVAVAWIRQPPGKALEWLAHIFSGDETSYTTSLQNRLTISKDTSKSQVVLIMTKMDPRDTGTYFCARVLTTWHGPDYWGQGTTVTVSS

SEQ ID NO: 1699 - protein, 11 aa, Artificial Sequence
  Description of Artificial Sequence: Synthetic heavy chain variable region CDR H1
FSLANPDVAVA

SEQ ID NO: 1700 - DNA, 33 bp, Artificial Sequence
  Description of Artificial Sequence: Synthetic heavy chain variable region CDR H1
ttctcactcgccaatcctgacgtggctgtggcc

SEQ ID NO: 1701 - protein, 16 aa, Artificial Sequence
  Description of Artificial Sequence: Synthetic heavy chain variable region CDR H2
HIFSGDETSYTTSLQN

SEQ ID NO: 1702 - DNA, 48 bp, Artificial Sequence
  Description of Artificial Sequence: Synthetic heavy chain variable region CDR H2
cacattttttcgggcgacgaaacatcctacaccacatctctgcagaac

SEQ ID NO: 1703 - protein, 12 aa, Artificial Sequence
  Description of Artificial Sequence: Synthetic heavy chain variable region CDR H3
ARVLTTWHGPDY

SEQ ID NO: 1704 - DNA, 36 bp, Artificial Sequence
  Description of Artificial Sequence: Synthetic heavy chain variable region CDR H3
gcacgggtgttgactacctggcacggaccggactac

SEQ ID NO: 1705 - DNA, 336 bp, Artificial Sequence
  Description of Artificial Sequence: Synthetic light chain variable region
gaaacgacactcacgcagtctccactctccctgcccgtcacccttggacagccggcctccatctcctgcaggtctgatcaaagcctcgtatatcataatggaaacacctacgtgagttggtttcatcagaggccaggccaatctccaaggcgcctaatttataaggtttctatccgggactctggggtcccagacagattcagcggcagtgggtcaggcactgatttcgcactgaaaatcagcagggtggaggctgaggatcttggggtttattactgcatgcaaggttcacactggccgcacacttttggccaggggaccaaagtggatatcaaa

SEQ ID NO: 1706 - protein, 112 aa, Artificial Sequence
  Description of Artificial Sequence: Synthetic light chain variable region
ETTLTQSPLSLPVTLGQPASISCRSDQSLVYHNGNTYVSWFHQRPGQSPRRLIYKVSIRDSGVPDRFSGSGSGTDFALKISRVEAEDLGVYYCMQGSHWPHTFGQGTKVDIK

SEQ ID NO: 1707 - protein, 16 aa, Artificial Sequence
  Description of Artificial Sequence: Synthetic light chain variable region CDR L1
RSDQSLVYHNGNTYVS

SEQ ID NO: 1708 - DNA, 48 bp, Artificial Sequence
  Description of Artificial Sequence: Synthetic light chain variable region CDR L1
aggtctgatcaaagcctcgtatatcataatggaaacacctacgtgagt

SEQ ID NO: 1709 - protein, 7 aa, Artificial Sequence
  Description of Artificial Sequence: Synthetic light chain variable region CDR L2
KVSIRDS

SEQ ID NO: 1710 - DNA, 21 bp, Artificial Sequence
  Description of Artificial Sequence: Synthetic light chain variable region CDR L2
aaggtttctatccgggactct

SEQ ID NO: 1711 - protein, 9 aa, Artificial Sequence
  Description of Artificial Sequence: Synthetic light chain variable region CDR L3
MQGSHWPHT

SEQ ID NO: 1712 - DNA, 27 bp, Artificial Sequence
  Description of Artificial Sequence: Synthetic light chain variable region CDR L3
atgcaaggttcacactggccgcacact

SEQ ID NO: 1713 - DNA, 366 bp, Artificial Sequence
  Description of Artificial Sequence: Synthetic heavy chain variable region
gaggtgcagctggtggagtctgggggaggcttggtccagcctggggggtccctgagactctcctgtgcagcctctggattctcgtttagtacctcttggatgagttgggtccgccaggctccagggaaaggtctggagtggctggccaacataaaggaagatggaagtaagaaaatctatgtggactctgtgaagggccgcttctccatatccagggacaacgccaagaactcactgtatctgcaaatgaccagcctaagagccgaggacacggccgtgtattattgtgcgagagatgtgtgggggtgggagctagtcggatggttggacccctggggccagggaaccctggtcaccgtctcctca

SEQ ID NO: 1714 - protein, 122 aa, Artificial Sequence
  Description of Artificial Sequence: Synthetic heavy chain variable region
EVQLVESGGGLVQPGGSLRLSCAASGFSFSTSWMSWVRQAPGKGLEWLANIKEDGSKKIYVDSVKGRFSISRDNAKNSLYLQMTSLRAEDTAVYYCARDVWGWELVGWLDPWGQGTLVTVSS

SEQ ID NO: 1715 - protein, 9 aa, Artificial Sequence
  Description of Artificial Sequence: Synthetic heavy chain variable region CDR H1
FSFSTSWMS

SEQ ID NO: 1716 - DNA, 27 bp, Artificial Sequence
  Description of Artificial Sequence: Synthetic heavy chain variable region CDR H1
ttctcgtttagtacctcttggatgagt

SEQ ID NO: 1717 - protein, 17 aa, Artificial Sequence
  Description of Artificial Sequence: Synthetic heavy chain variable region CDR H2
NIKEDGSKKIYVDSVKG

SEQ ID NO: 1718 - DNA, 51 bp, Artificial Sequence
  Description of Artificial Sequence: Synthetic heavy chain variable region CDR H2
aacataaaggaagatggaagtaagaaaatctatgtggactctgtgaagggc

SEQ ID NO: 1719 - protein, 15 aa, Artificial Sequence
  Description of Artificial Sequence: Synthetic heavy chain variable region CDR H3
ARDVWGWELVGWLDP

SEQ ID NO: 1720 - DNA, 45 bp, Artificial Sequence
  Description of Artificial Sequence: Synthetic heavy chain variable region CDR H3
gcgagagatgtgtgggggtgggagctagtcggatggttggacccc

SEQ ID NO: 1721 - DNA, 324 bp, Artificial Sequence
  Description of Artificial Sequence: Synthetic light chain variable region
tcctatgagctgacacagccaccctcggtatcagtggccccaggaaagacggccagcattacctgtgggggaagcaacattggaagtagaagtgtgcactggtaccagcagaagccaggccaggcccctgtgctggtcgtctatgaggatcacgaccggccctcagggatccctgagcgattctctggctccaactctgggaatacggccaccctgaccatcagcagggtcgaagccggggacgaggccgactattactgtcaggtgtgggatagtagtagagatcatgtggtattcggcggcgggaccaaggtcaccgtccta

SEQ ID NO: 1722 - protein, 108 aa, Artificial Sequence
  Description of Artificial Sequence: Synthetic light chain variable region
SYELTQPPSVSVAPGKTASITCGGSNIGSRSVHWYQQKPGQAPVLVVYEDHDRPSGIPERFSGSNSGNTATLTISRVEAGDEADYYCQVWDSSRDHVVFGGGTKVTVL

SEQ ID NO: 1723 - protein, 11 aa, Artificial Sequence
  Description of Artificial Sequence: Synthetic light chain variable region CDR L1
GGSNIGSRSVH

SEQ ID NO: 1724 - DNA, 33 bp, Artificial Sequence
  Description of Artificial Sequence: Synthetic light chain variable region CDR L1
gggggaagcaacattggaagtagaagtgtgcac

SEQ ID NO: 1725 - protein, 7 aa, Artificial Sequence
  Description of Artificial Sequence: Synthetic light chain variable region CDR L2
EDHDRPS

SEQ ID NO: 1726 - DNA, 21 bp, Artificial Sequence
  Description of Artificial Sequence: Synthetic light chain variable region CDR L2
gaggatcacgaccggccctca

SEQ ID NO: 1727 - protein, 11 aa, Artificial Sequence
  Description of Artificial Sequence: Synthetic light chain variable region CDR L3
QVWDSSRDHVV

SEQ ID NO: 1728 - DNA, 33 bp, Artificial Sequence
  Description of Artificial Sequence: Synthetic light chain variable region CDR L3
caggtgtgggatagtagtagagatcatgtggta

SEQ ID NO: 1729 - DNA, 378 bp, Artificial Sequence
  Description of Artificial Sequence: Synthetic heavy chain variable region
gaggtgcagctggtggagtctggtcctgcgctggtgaaacccacacagaccctcacactgacctgcaccttctctgggttctcactcagcagtagaagaatgtgtgtgagttggatccgtcagcccccagggaaggccctggagtggcttgcacgcattgattgggatgatgataaatcctacagcacatctctgaagaccaggctcaccatcgccaaggacacctccaaaaaccaggtcgtccttacaatgaccaacatgggccccgcggacacagccacgtattactgtgcacggactcctatatatgatagtagtggttattacctctactactttgactcctggggccagggaaccctggtcaccgtctcctca

SEQ ID NO: 1730 - protein, 126 aa, Artificial Sequence
  Description of Artificial Sequence: Synthetic heavy chain variable region
EVQLVESGPALVKPTQTLTLTCTFSGFSLSSRRMCVSWIRQPPGKALEWLARIDWDDDKSYSTSLKTRLTIAKDTSKNQVVLTMTNMGPADTATYYCARTPIYDSSGYYLYYFDSWGQGTLVTVSS

SEQ ID NO: 1731 - protein, 11 aa, Artificial Sequence
  Description of Artificial Sequence: Synthetic heavy chain variable region CDR H1
FSLSSRRMCVS

SEQ ID NO: 1732 - DNA, 33 bp, Artificial Sequence
  Description of Artificial Sequence: Synthetic heavy chain variable region CDR H1
ttctcactcagcagtagaagaatgtgtgtgagt

SEQ ID NO: 1733 - protein, 16 aa, Artificial Sequence
  Description of Artificial Sequence: Synthetic heavy chain variable region CDR H2
RIDWDDDKSYSTSLKT

SEQ ID NO: 1734 - DNA, 48 bp, Artificial Sequence; identical to SEQ ID NO: 582
  Description of Artificial Sequence: Synthetic heavy chain variable region CDR H2

SEQ ID NO: 1735 - protein, 18 aa, Artificial Sequence
  Description of Artificial Sequence: Synthetic heavy chain variable region CDR H3
ARTPIYDSSGYYLYYFDS

SEQ ID NO: 1736 - DNA, 54 bp, Artificial Sequence
  Description of Artificial Sequence: Synthetic heavy chain variable region CDR H3
gcacggactcctatatatgatagtagtggttattacctctactactttgactcc

SEQ ID NO: 1737 - DNA, 321 bp, Artificial Sequence
  Description of Artificial Sequence: Synthetic light chain variable region
gaaacgacactcacgcagtctccatcctccctgtctgcatctgtcggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctgtgacttttggccaggggaccaaggtggagatcaaa

SEQ ID NO: 1738 - protein, 107 aa, Artificial Sequence
  Description of Artificial Sequence: Synthetic light chain variable region
ETTLTQSPSSLSASVGDRVTITCRASQSISSYLNWYQQKPGKAPKLLIYAASSLQSGVPSRFSGSGSGTDFTLTISSLQPEDFATYYCQQSYSTPVTFGQGTKVEIK

SEQ ID NO: 1739 - protein, 11 aa, Artificial Sequence
  Description of Artificial Sequence: Synthetic light chain variable region CDR L1
RASQSISSYLN

SEQ ID NO: 1740 - DNA, 33 bp, Artificial Sequence
  Description of Artificial Sequence: Synthetic light chain variable region CDR L1
cgggcaagtcagagcattagcagctatttaaat

SEQ ID NO: 1741 - protein, 7 aa, Artificial Sequence
  Description of Artificial Sequence: Synthetic light chain variable region CDR L2
AASSLQS

SEQ ID NO: 1742 - DNA, 21 bp, Artificial Sequence
  Description of Artificial Sequence: Synthetic light chain variable region CDR L2
gctgcatccagtttgcaaagt

SEQ ID NO: 1743 - protein, 9 aa, Artificial Sequence
  Description of Artificial Sequence: Synthetic light chain variable region CDR L3
QQSYSTPVT

SEQ ID NO: 1744 - DNA, 27 bp, Artificial Sequence
  Description of Artificial Sequence: Synthetic light chain variable region CDR L3
caacagagttacagtacccctgtgact

SEQ ID NO: 1745 - DNA, 372 bp, Artificial Sequence
  Description of Artificial Sequence: Synthetic heavy chain variable region
caggtccagcttgtgcagtctgggggaggcgtggtccagcctgggaggtccctgagactctcctgtgcagcctctggattcaccttcagtgactatgctatgcactgggtccgccaggctccaggcaagggcctccagtgggtgtcacttatatcatataatggacgtaaaaaatattacgcagactccgtgaagggccgattcaccatctccagagacgattccaagaacacgctgtatctgcaaatgaaccccctgagacctgacgacacggctgtctattactgtgcgagagatggggatattgtagctgttccagctgctatcgggttggactactggggccagggaaccctggtcaccgtctcctca

SEQ ID NO: 1746 - protein, 124 aa, Artificial Sequence
  Description of Artificial Sequence: Synthetic heavy chain variable region
QVQLVQSGGGVVQPGRSLRLSCAASGFTFSDYAMHWVRQAPGKGLQWVSLISYNGRKKYYADSVKGRFTISRDDSKNTLYLQMNPLRPDDTAVYYCARDGDIVAVPAAIGLDYWGQGTLVTVSS

SEQ ID NO: 1747 - protein, 9 aa, Artificial Sequence
  Description of Artificial Sequence: Synthetic heavy chain variable region CDR H1
FTFSDYAMH

SEQ ID NO: 1748 - DNA, 27 bp, Artificial Sequence
  Description of Artificial Sequence: Synthetic heavy chain variable region CDR H1
ttcaccttcagtgactatgctatgcac

SEQ ID NO: 1749 - protein, 17 aa, Artificial Sequence
  Description of Artificial Sequence: Synthetic heavy chain variable region CDR H2
LISYNGRKKYYADSVKG

SEQ ID NO: 1750 - DNA, 51 bp, Artificial Sequence
  Description of Artificial Sequence: Synthetic heavy chain variable region CDR H2
cttatatcatataatggacgtaaaaaatattacgcagactccgtgaagggc

SEQ ID NO: 1751 - protein, 17 aa, Artificial Sequence
  Description of Artificial Sequence: Synthetic heavy chain variable region CDR H3
ARDGDIVAVPAAIGLDY

SEQ ID NO: 1752 - DNA, 51 bp, Artificial Sequence
  Description of Artificial Sequence: Synthetic heavy chain variable region CDR H3
gcgagagatggggatattgtagctgttccagctgctatcgggttggactac

SEQ ID NO: 1753 - DNA, 339 bp, Artificial Sequence
  Description of Artificial Sequence: Synthetic light chain variable region
gatattgtgctgacccagtctccagagtccctggctgtgtctctgggcgagagggccaccatcaactgcaactccagccagagtgttttatacacctccaacaacaagaactacttagcttggtaccagcagaaatcaggacagcctcctaagctgctcatttactgggcatctacccgggaatccggggtccctgagcgattcagtggcagcgggtctgggacagatttcactctcaccatcagcagcctgcaggctgaagatgtggcagtttattactgtcagcaatattctagtcctccgtacacttttggccaggggaccaagctggagatcaaa

SEQ ID NO: 1754 - protein, 113 aa, Artificial Sequence
  Description of Artificial Sequence: Synthetic light chain variable region
DIVLTQSPESLAVSLGERATINCNSSQSVLYTSNNKNYLAWYQQKSGQPPKLLIYWASTRESGVPERFSGSGSGTDFTLTISSLQAEDVAVYYCQQYSSPPYTFGQGTKLEIK

SEQ ID NO: 1755 - protein, 17 aa, Artificial Sequence
  Description of Artificial Sequence: Synthetic light chain variable region CDR L1
NSSQSVLYTSNNKNYLA

SEQ ID NO: 1756 - DNA, 51 bp, Artificial Sequence
  Description of Artificial Sequence: Synthetic light chain variable region CDR L1
aactccagccagagtgttttatacacctccaacaacaagaactacttagct

SEQ ID NO: 1757 - protein, 7 aa, Artificial Sequence
  Description of Artificial Sequence: Synthetic light chain variable region CDR L2
WASTRES

SEQ ID NO: 1758 - DNA, 21 bp, Artificial Sequence
  Description of Artificial Sequence: Synthetic light chain variable region CDR L2
tgggcatctacccgggaatcc

SEQ ID NO: 1759 - protein, 9 aa, Artificial Sequence
  Description of Artificial Sequence: Synthetic light chain variable region CDR L3
QQYSSPPYT

SEQ ID NO: 1760 - DNA, 27 bp, Artificial Sequence
  Description of Artificial Sequence: Synthetic light chain variable region CDR L3
cagcaatattctagtcctccgtacact

SEQ ID NO: 1761 - DNA, 366 bp, Artificial Sequence
  Description of Artificial Sequence: Synthetic heavy chain variable region
caggtgcagctgcaggagtccggcccaggactagtgaagccttcagagaccctgtccctcacttgcagtgtctctggtggctccatcaaaagaggtgcttacttctggacctggatccgccagcggccagggaagggcctggagtggattgggtccatgcatgacagcggcgactactacaacccgtccctcaagacacgcgttaccattttgggagacacgactaagaaccacttcaccctgaagttgacctccgtgactgtcgcggacacggccttatattactgtgcgagggggcgcggatacagctatggctggcgtttctttgacaactggggccagggaaccctggtcaccgtctcctca

SEQ ID NO: 1762 - protein, 122 aa, Artificial Sequence
  Description of Artificial Sequence: Synthetic heavy chain variable region
QVQLQESGPGLVKPSETLSLTCSVSGGSIKRGAYFWTWIRQRPGKGLEWIGSMHDSGDYYNPSLKTRVTILGDTTKNHFTLKLTSVTVADTALYYCARGRGYSYGWRFFDNWGQGTLVTVSS

SEQ ID NO: 1763 - protein, 11 aa, Artificial Sequence
  Description of Artificial Sequence: Synthetic heavy chain variable region CDR H1
GSIKRGAYFWT

SEQ ID NO: 1764 - DNA, 33 bp, Artificial Sequence
  Description of Artificial Sequence: Synthetic heavy chain variable region CDR H1
ggctccatcaaaagaggtgcttacttctggacc

SEQ ID NO: 1765 - protein, 15 aa, Artificial Sequence
  Description of Artificial Sequence: Synthetic heavy chain variable region CDR H2
SMHDSGDYYNPSLKT

SEQ ID NO: 1766 - DNA, 45 bp, Artificial Sequence
  Description of Artificial Sequence: Synthetic heavy chain variable region CDR H2
tccatgcatgacagcggcgactactacaacccgtccctcaagaca

SEQ ID NO: 1767 - protein, 15 aa, Artificial Sequence
  Description of Artificial Sequence: Synthetic heavy chain variable region CDR H3
ARGRGYSYGWRFFDN

SEQ ID NO: 1768 - DNA, 45 bp, Artificial Sequence
  Description of Artificial Sequence: Synthetic heavy chain variable region CDR H3
gcgagggggcgcggatacagctatggctggcgtttctttgacaac

SEQ ID NO: 1769 - DNA, 324 bp, Artificial Sequence
  Description of Artificial Sequence: Synthetic light chain variable region
aattttatgctgactcagcccccctcggtgtcagtgtccccaggacactcgaccaggatcacctgctctggagatgctttgccaaagcaatatgcttattggtatcagcagaagccaggccaggcccctgtcctgataatgtccaaagacagtgagaggccctcagggatccctgagcgattcactggctccagctcagggactacagtcactttgaccatcagtggagtccaggcagaggacgaggccgactattactgtcaatcaggagacaccagtggaagttatgtcgtcttcggcggagggaccaaggtcaccgtccta

SEQ ID NO: 1770 - protein, 108 aa, Artificial Sequence
  Description of Artificial Sequence: Synthetic light chain variable region
NFMLTQPPSVSVSPGHSTRITCSGDALPKQYAYWYQQKPGQAPVLIMSKDSERPSGIPERFTGSSSGTTVTLTISGVQAEDEADYYCQSGDTSGSYVVFGGGTKVTVL

SEQ ID NO: 1771 - protein, 11 aa, Artificial Sequence
  Description of Artificial Sequence: Synthetic light chain variable region CDR L1
SGDALPKQYAY

SEQ ID NO: 1772 - DNA, 33 bp, Artificial Sequence
  Description of Artificial Sequence: Synthetic light chain variable region CDR L1
tctggagatgctttgccaaagcaatatgcttat

SEQ ID NO: 1773 - protein, 7 aa, Artificial Sequence
  Description of Artificial Sequence: Synthetic light chain variable region CDR L2
KDSERPS

SEQ ID NO: 1774 - DNA, 21 bp, Artificial Sequence
  Description of Artificial Sequence: Synthetic light chain variable region CDR L2
aaagacagtgagaggccctca

SEQ ID NO: 1775 - protein, 11 aa, Artificial Sequence
  Description of Artificial Sequence: Synthetic light chain variable region CDR L3
QSGDTSGSYVV

SEQ ID NO: 1776 - DNA, 33 bp, Artificial Sequence
  Description of Artificial Sequence: Synthetic light chain variable region CDR L3
caatcaggagacaccagtggaagttatgtcgtc

SEQ ID NO: 1777 - DNA, 390 bp, Artificial Sequence
  Description of Artificial Sequence: Synthetic heavy chain variable region
gaggtgcagctgttggagtccgggccagagttgaagaagcctgggtcctcggtgaaggtgtcttgcaaggcctctgcagacactttcaatggtcactcaattgcttgggtgcggcaggcccctggacaagggcttgagtgggtgggaggattcatccccatttttgggaaagcatactacgcacagaacttccagggcacagtcacgatttccgcggattcttccacgagaacagtctacatggatctgttcaacctgagatctgaggacacggccgtctattactgtgcgagatcaaggaaaaatgttatcggggacaccagtgcctgggaacatatgtacttctacatggacgtctggggcaccgggaccacggtcaccgtctcctca

SEQ ID NO: 1778 - protein, 130 aa, Artificial Sequence
  Description of Artificial Sequence: Synthetic heavy chain variable region
EVQLLESGPELKKPGSSVKVSCKASADTFNGHSIAWVRQAPGQGLEWVGGFIPIFGKAYYAQNFQGTVTISADSSTRTVYMDLFNLRSEDTAVYYCARSRKNVIGDTSAWEHMYFYMDVWGTGTTVTVSS

SEQ ID NO: 1779 - protein, 9 aa, Artificial Sequence
  Description of Artificial Sequence: Synthetic heavy chain variable region CDR H1
DTFNGHSIA

SEQ ID NO: 1780 - DNA, 27 bp, Artificial Sequence
  Description of Artificial Sequence: Synthetic heavy chain variable region CDR H1
gacactttcaatggtcactcaattgct

SEQ ID NO: 1781 - protein, 17 aa, Artificial Sequence
  Description of Artificial Sequence: Synthetic heavy chain variable region CDR H2
GFIPIFGKAYYAQNFQG

SEQ ID NO: 1782 - DNA, 51 bp, Artificial Sequence
  Description of Artificial Sequence: Synthetic heavy chain variable region CDR H2
ggattcatccccatttttgggaaagcatactacgcacagaacttccagggc

SEQ ID NO: 1783 - protein, 23 aa, Artificial Sequence
  Description of Artificial Sequence: Synthetic heavy chain variable region CDR H3
ARSRKNVIGDTSAWEHMYFYMDV

SEQ ID NO: 1784 - DNA, 69 bp, Artificial Sequence
  Description of Artificial Sequence: Synthetic heavy chain variable region CDR H3
gcgagatcaaggaaaaatgttatcggggacaccagtgcctgggaacatatgtacttctacatggacgtc

SEQ ID NO: 1785 - DNA, 324 bp, Artificial Sequence
  Description of Artificial Sequence: Synthetic light chain variable region
gaaattgtattgacgcagtctccaggcaccctgtctttgtctccaggggaaagagtcactctctcctgcagggccagtgagagtattaataagaatacctacttagcctggtaccaacagaaacctggccaggctcccaggctcctcatttatggagcatccagcagggccactggcatcccagacaggttcagtggcagtgggtctgggacagacttcactctcaccatcagcagactggagcctgaagattctgctgtgtattactgtcagcaatatggtaggtcaatgactttcggcggagggaccaaggtggaaatcaaa

SEQ ID NO: 1786 - protein, 108 aa, Artificial Sequence
  Description of Artificial Sequence: Synthetic light chain variable region
EIVLTQSPGTLSLSPGERVTLSCRASESINKNTYLAWYQQKPGQAPRLLIYGASSRATGIPDRFSGSGSGTDFTLTISRLEPEDSAVYYCQQYGRSMTFGGGTKVEIK

SEQ ID NO: 1787 - protein, 13 aa, Artificial Sequence
  Description of Artificial Sequence: Synthetic light chain variable region CDR L1
RASESINKNTYLA

SEQ ID NO: 1788 - DNA, 39 bp, Artificial Sequence
  Description of Artificial Sequence: Synthetic light chain variable region CDR L1
agggccagtgagagtattaataagaatacctacttagcc

SEQ ID NO: 1789 - protein, 7 aa, Artificial Sequence
  Description of Artificial Sequence: Synthetic light chain variable region CDR L2
GASSRAT

SEQ ID NO: 1790 - DNA, 21 bp, Artificial Sequence
  Description of Artificial Sequence: Synthetic light chain variable region CDR L2
ggagcatccagcagggccact

SEQ ID NO: 1791 - protein, 8 aa, Artificial Sequence
  Description of Artificial Sequence: Synthetic light chain variable region CDR L3
QQYGRSMT

SEQ ID NO: 1792 - DNA, 24 bp, Artificial Sequence
  Description of Artificial Sequence: Synthetic light chain variable region CDR L3
cagcaatatggtaggtcaatgact

SEQ ID NO: 1793 - DNA, 393 bp, Artificial Sequence
  Description of Artificial Sequence: Synthetic heavy chain variable region
caggtccagcttgtacagtctgggactgaggtgaagaagcctgggtcctcggtgaatgtctcctgcaaggctgttggaggcaagttcaccagttataatattaactgggtgcgacaggcccctggacaaggccttgagtggatgggaaggatcatcccaacccttggtataacatacttcgcacagaagttccagggcagactcacgattaacgcggacagatccacgagcaccgcctacatggatctgagcagcctgagatctgacgatacggccgtttattattgtgcgagatccaatcccgttgctcgcgatttttggagtggatattctgacgactcctcctatgctatggacgtctggggccaagggaccacggtcaccgtctcctca

SEQ ID NO: 1794 - protein, 131 aa, Artificial Sequence
  Description of Artificial Sequence: Synthetic heavy chain variable region
QVQLVQSGTEVKKPGSSVNVSCKAVGGKFTSYNINWVRQAPGQGLEWMGRIIPTLGITYFAQKFQGRLTINADRSTSTAYMDLSSLRSDDTAVYYCARSNPVARDFWSGYSDDSSYAMDVWGQGTTVTVSS

SEQ ID NO: 1795 - protein, 9 aa, Artificial Sequence
  Description of Artificial Sequence: Synthetic heavy chain variable region CDR H1
GKFTSYNIN

SEQ ID NO: 1796 - DNA, 27 bp, Artificial Sequence
  Description of Artificial Sequence: Synthetic heavy chain variable region CDR H1
ggcaagttcaccagttataatattaac

SEQ ID NO: 1797 - protein, 17 aa, Artificial Sequence
  Description of Artificial Sequence: Synthetic heavy chain variable region CDR H2
RIIPTLGITYFAQKFQG

SEQ ID NO: 1798 - DNA, 51 bp, Artificial Sequence
  Description of Artificial Sequence: Synthetic heavy chain variable region CDR H2
aggatcatcccaacccttggtataacatacttcgcacagaagttccagggc

SEQ ID NO: 1799 - protein, 24 aa, Artificial Sequence
  Description of Artificial Sequence: Synthetic heavy chain variable region CDR H3
ARSNPVARDFWSGYSDDSSYAMDV

SEQ ID NO: 1800 - DNA, 72 bp, Artificial Sequence
  Description of Artificial Sequence: Synthetic heavy chain variable region CDR H3
gcgagatccaatcccgttgctcgcgatttttggagtggatattctgacgactcctcctatgctatggacgtc

SEQ ID NO: 1801 - DNA, 324 bp, Artificial Sequence
  Description of Artificial Sequence: Synthetic light chain variable region
gaaacgacactcacgcagtctccaggaaccctgtctttgtctccaggggacagagtcagcctctcctgcagggccagtcagactgttgacaagaactacgtagcctggtaccagcagaagcctggccaggctcccaggctcctcatctatggtgcatccaagagggccgctgacatcccagacaggttcagtggcagtggctctggggcagacttcactctcaccatcagcagactggagcctgaagattttgctgtgtatcactgtcagcagtatggagcttcagcgttcagtttcggcggcgggaccaagctggagatcaaa

SEQ ID NO: 1802 - protein, 108 aa, Artificial Sequence
  Description of Artificial Sequence: Synthetic light chain variable region
ETTLTQSPGTLSLSPGDRVSLSCRASQTVDKNYVAWYQQKPGQAPRLLIYGASKRAADIPDRFSGSGSGADFTLTISRLEPEDFAVYHCQQYGASAFSFGGGTKLEIK

SEQ ID NO: 1803 - protein, 12 aa, Artificial Sequence
  Description of Artificial Sequence: Synthetic light chain variable region CDR L1
RASQTVDKNYVA

SEQ ID NO: 1804 - DNA, 36 bp, Artificial Sequence
  Description of Artificial Sequence: Synthetic light chain variable region CDR L1
agggccagtcagactgttgacaagaactacgtagcc

SEQ ID NO: 1805 - protein, 7 aa, Artificial Sequence
  Description of Artificial Sequence: Synthetic light chain variable region CDR L2
GASKRAA

SEQ ID NO: 1806 - DNA, 21 bp, Artificial Sequence
  Description of Artificial Sequence: Synthetic light chain variable region CDR L2
ggtgcatccaagagggccgct

SEQ ID NO: 1807 - protein, 9 aa, Artificial Sequence
  Description of Artificial Sequence: Synthetic light chain variable region CDR L3
QQYGASAFS

SEQ ID NO: 1808 - DNA, 27 bp, Artificial Sequence
  Description of Artificial Sequence: Synthetic light chain variable region CDR L3
cagcagtatggagcttcagcgttcagt

SEQ ID NO: 1809 - DNA, 384 bp, Artificial Sequence
  Description of Artificial Sequence: Synthetic heavy chain variable region
caggtgcagctggtgcaatctgggggaggcttggtaaagccgggggggtcccttagactctcatgtgcagcctctggattcgctttcagtaacgcctggatgagctgggtccgccaggctccagggaaggggctggagtggcttggccgtattaaaagcgaaactgacggtgggacaacagactacgctgcacccgtgaaaggcagattcagcatctcaagagatgattccagaaacacgctgtatctgcaaatgaacagcctggaaagcgaggacacagccgtttattactgtaccacaggcccaccctataagtattttgatagtactggttattcggtcgttgactactggggccagggaaccctggtcaccgtctcctca

SEQ ID NO: 1810 - protein, 128 aa, Artificial Sequence
  Description of Artificial Sequence: Synthetic heavy chain variable region
QVQLVQSGGGLVKPGGSLRLSCAASGFAFSNAWMSWVRQAPGKGLEWLGRIKSETDGGTTDYAAPVKGRFSISRDDSRNTLYLQMNSLESEDTAVYYCTTGPPYKYFDSTGYSVVDYWGQGTLVTVSS

SEQ ID NO: 1811 - protein, 9 aa, Artificial Sequence
  Description of Artificial Sequence: Synthetic heavy chain variable region CDR H1
FAFSNAWMS

SEQ ID NO: 1812 - DNA, 27 bp, Artificial Sequence
  Description of Artificial Sequence: Synthetic heavy chain variable region CDR H1
ttcgctttcagtaacgcctggatgagc

SEQ ID NO: 1813 - protein, 19 aa, Artificial Sequence
  Description of Artificial Sequence: Synthetic heavy chain variable region CDR H2
RIKSETDGGTTDYAAPVKG

SEQ ID NO: 1814 - DNA, 57 bp, Artificial Sequence
  Description of Artificial Sequence: Synthetic heavy chain variable region CDR H2
cgtattaaaagcgaaactgacggtgggacaacagactacgctgcacccgtgaaaggc

SEQ ID NO: 1815 - protein, 19 aa, Artificial Sequence
  Description of Artificial Sequence: Synthetic heavy chain variable region CDR H3
TTGPPYKYFDSTGYSVVDY

SEQ ID NO: 1816 - DNA, 57 bp, Artificial Sequence
  Description of Artificial Sequence: Synthetic heavy chain variable region CDR H3
accacaggcccaccctataagtattttgatagtactggttattcggtcgttgactac

SEQ ID NO: 1817 - DNA, 330 bp, Artificial Sequence
  Description of Artificial Sequence: Synthetic light chain variable region
tcctatgagctgacacagccaccctcagcgtctgggacccccgggcagagggtcaccatctcttgttctggaagcagctccaatatcggaagtaattatgtatactggtaccagcagctcccaggaacggcccccagactcctcatctatagtactaatcagcggccctcaggggtccctgaccgattctctggctcccagtctggcacctcagcctccctggccatcagtgggctccggtccgacgatgaggctgattattactgtgcagcatgggatgacaggatgagtggtccggtgttcggcggagggaccaagctcaccgtccta

SEQ ID NO: 1818 - protein, 110 aa, Artificial Sequence
  Description of Artificial Sequence: Synthetic light chain variable region
SYELTQPPSASGTPGQRVTISCSGSSSNIGSNYVYWYQQLPGTAPRLLIYSTNQRPSGVPDRFSGSQSGTSASLAISGLRSDDEADYYCAAWDDRMSGPVFGGGTKLTVL

SEQ ID NO: 1819 - protein, 13 aa, Artificial Sequence
  Description of Artificial Sequence: Synthetic light chain variable region CDR L1
SGSSSNIGSNYVY

SEQ ID NO: 1820 - DNA, 39 bp, Artificial Sequence
  Description of Artificial Sequence: Synthetic light chain variable region CDR L1
tctggaagcagctccaatatcggaagtaattatgtatac

SEQ ID NO: 1821 - protein, 7 aa, Artificial Sequence
  Description of Artificial Sequence: Synthetic light chain variable region CDR L2
STNQRPS

SEQ ID NO: 1822 - DNA, 21 bp, Artificial Sequence
  Description of Artificial Sequence: Synthetic light chain variable region CDR L2
agtactaatcagcggccctca

SEQ ID NO: 1823 - protein, 11 aa, Artificial Sequence
  Description of Artificial Sequence: Synthetic light chain variable region CDR L3
AAWDDRMSGPV

SEQ ID NO: 1824 - DNA, 33 bp, Artificial Sequence
  Description of Artificial Sequence: Synthetic light chain variable region CDR L3
gcagcatgggatgacaggatgagtggtccggtg

SEQ ID NO: 1825 - DNA, 372 bp, Artificial Sequence
  Description of Artificial Sequence: Synthetic heavy chain variable region
caggtccagcttgtacagtctgggggaggcttggtgcagcctggggggtccctaagactctcctgtgcagcctctggactcacctttagctcttatgccatgtcctgggtccgccaggctccagggaaggaactggagtgggtctcatctattagtgaaagtggtgttgatacatactacgcagactccgtgaagggccggttcaccgtctccagagacaattccaaaagcacgctgtatctgcaaatgagcagcctgggaggcgacgacacggccgtatattattgcgcgaaggcatactgtagtaataaggcctgccacgggggctactttgactactggggccagggaaccctggtcaccgtctcctca

SEQ ID NO: 1826 - protein, 124 aa, Artificial Sequence
  Description of Artificial Sequence: Synthetic heavy chain variable region
QVQLVQSGGGLVQPGGSLRLSCAASGLTFSSYAMSWVRQAPGKELEWVSSISESGVDTYYADSVKGRFTVSRDNSKSTLYLQMSSLGGDDTAVYYCAKAYCSNKACHGGYFDYWGQGTLVTVSS

SEQ ID NO: 1827 - protein, 9 aa, Artificial Sequence
  Description of Artificial Sequence: Synthetic heavy chain variable region CDR H1
LTFSSYAMS

SEQ ID NO: 1828 - DNA, 27 bp, Artificial Sequence
  Description of Artificial Sequence: Synthetic heavy chain variable region CDR H1
ctcacctttagctcttatgccatgtcc

SEQ ID NO: 1829 - protein, 17 aa, Artificial Sequence
  Description of Artificial Sequence: Synthetic heavy chain variable region CDR H2
SISESGVDTYYADSVKG

SEQ ID NO: 1830 - DNA, 51 bp, Artificial Sequence
  Description of Artificial Sequence: Synthetic heavy chain variable region CDR H2
tctattagtgaaagtggtgttgatacatactacgcagactccgtgaagggc

SEQ ID NO: 1831 - protein, 17 aa, Artificial Sequence
  Description of Artificial Sequence: Synthetic heavy chain variable region CDR H3
AKAYCSNKACHGGYFDY

SEQ ID NO: 1832 - DNA, 51 bp, Artificial Sequence
  Description of Artificial Sequence: Synthetic heavy chain variable region CDR H3
gcgaaggcatactgtagtaataaggcctgccacgggggctactttgactac

SEQ ID NO: 1833 - DNA, 321 bp, Artificial Sequence
  Description of Artificial Sequence: Synthetic light chain variable region
gaaacgacactcacgcagtctccagacaccctgtccttgtctccaggggaaagggccaccctctcctgcagggccagtcagagtgttaggaactacttagcctggtaccggcagaaacctggccaggctcccaggctcctcatctatgatgcatccaacctggccactggcatcccagccaggttcagtggcagcgggtctgggacagacttcactctcaccatcagcagcctagagcctgaagattttgcagtttattactgtcaccagcgtagcgactggccgctcactttcggccctgggaccaaggtggaaatcaaa

SEQ ID NO: 1834 - protein, 107 aa, Artificial Sequence
  Description of Artificial Sequence: Synthetic light chain variable region
ETTLTQSPDTLSLSPGERATLSCRASQSVRNYLAWYRQKPGQAPRLLIYDASNLATGIPARFSGSGSGTDFTLTISSLEPEDFAVYYCHQRSDWPLTFGPGTKVEIK

SEQ ID NO: 1835 - protein, 11 aa, Artificial Sequence
  Description of Artificial Sequence: Synthetic light chain variable region CDR L1
RASQSVRNYLA

SEQ ID NO: 1836 - DNA, 33 bp, Artificial Sequence
  Description of Artificial Sequence: Synthetic light chain variable region CDR L1
agggccagtcagagtgttaggaactacttagcc

SEQ ID NO: 1837 - protein, 7 aa, Artificial Sequence
  Description of Artificial Sequence: Synthetic light chain variable region CDR L2
DASNLAT

SEQ ID NO: 1838 - DNA, 21 bp, Artificial Sequence
  Description of Artificial Sequence: Synthetic light chain variable region CDR L2
gatgcatccaacctggccact

SEQ ID NO: 1839 - protein, 9 aa, Artificial Sequence
  Description of Artificial Sequence: Synthetic light chain variable region CDR L3
HQRSDWPLT

SEQ ID NO: 1840 - DNA, 27 bp, Artificial Sequence
  Description of Artificial Sequence: Synthetic light chain variable region CDR L3
caccagcgtagcgactggccgctcact

SEQ ID NO: 1841 - DNA, 360 bp, Artificial Sequence
  Description of Artificial Sequence: Synthetic heavy chain variable region
gaggtgcagctggtggagtcggggggaggcttggtccagcctggggggtccctgagactctcctgtgcagcctctggattcacctttaggagctattggatgacctgggtccgccaggctccagggaaagggctggagtgggtggccagcataaacgatgaggggaatactaaatactatgtggactctctgaagggccgattcaccatctccagagacaacgccaagaactcactttatctccaaatgaacagcctgcgagccgaggacacggctgtttattactgtgcgagggagtccggtctgccccggggtgcctttcaaatctggggcccagggacaatggtcaccgtctcttca

SEQ ID NO: 1842 - protein, 120 aa, Artificial Sequence
  Description of Artificial Sequence: Synthetic heavy chain variable region
EVQLVESGGGLVQPGGSLRLSCAASGFTFRSYWMTWVRQAPGKGLEWVASINDEGNTKYYVDSLKGRFTISRDNAKNSLYLQMNSLRAEDTAVYYCARESGLPRGAFQIWGPGTMVTVSS

SEQ ID NO: 1843 - protein, 9 aa, Artificial Sequence
  Description of Artificial Sequence: Synthetic heavy chain variable region CDR H1
FTFRSYWMT

SEQ ID NO: 1844 - DNA, 27 bp, Artificial Sequence
  Description of Artificial Sequence: Synthetic heavy chain variable region CDR H1
ttcacctttaggagctattggatgacc

SEQ ID NO: 1845 - protein, 17 aa, Artificial Sequence
  Description of Artificial Sequence: Synthetic heavy chain variable region CDR H2
SINDEGNTKYYVDSLKG

SEQ ID NO: 1846 - DNA, 51 bp, Artificial Sequence
  Description of Artificial Sequence: Synthetic heavy chain variable region CDR H2
agcataaacgatgaggggaatactaaatactatgtggactctctgaagggc

SEQ ID NO: 1847 - protein, 13 aa, Artificial Sequence
  Description of Artificial Sequence: Synthetic heavy chain variable region CDR H3
ARESGLPRGAFQI

SEQ ID NO: 1848 - DNA, 39 bp, Artificial Sequence
  Description of Artificial Sequence: Synthetic heavy chain variable region CDR H3
gcgagggagtccggtctgccccggggtgcctttcaaatc

SEQ ID NO: 1849 - DNA, 318 bp, Artificial Sequence
  Description of Artificial Sequence: Synthetic light chain variable region
gaaattgtattgacacagtctccagtcaccctgtctttgtctccaggggaaagagccaccctctcatgcagggccagtcagagtgttggcaccttcttagcctggtatcaacacaaacctggccaggctcccaggctcctcatctatgatgcatccaacagggcctctgccatcccagccaggttcagtggcagtgggtctgggacagacttcactctcaccatcagcagcctggagcctgaagattttgcagtttattactgtcagcatcgtagcgactggtggacgttcggccaagggaccaaggtggaaatcaaa

SEQ ID NO: 1850 - protein, 106 aa, Artificial Sequence
  Description of Artificial Sequence: Synthetic light chain variable region
EIVLTQSPVTLSLSPGERATLSCRASQSVGTFLAWYQHKPGQAPRLLIYDASNRASAIPARFSGSGSGTDFTLTISSLEPEDFAVYYCQHRSDWWTFGQGTKVEIK

SEQ ID NO: 1851 - protein, 11 aa, Artificial Sequence
  Description of Artificial Sequence: Synthetic light chain variable region CDR L1
RASQSVGTFLA

SEQ ID NO: 1852 - DNA, 33 bp, Artificial Sequence
  Description of Artificial Sequence: Synthetic light chain variable region CDR L1
agggccagtcagagtgttggcaccttcttagcc

SEQ ID NO: 1853 - protein, 7 aa, Artificial Sequence
  Description of Artificial Sequence: Synthetic light chain variable region CDR L2
DASNRAS

SEQ ID NO: 1854 - DNA, 21 bp, Artificial Sequence
  Description of Artificial Sequence: Synthetic light chain variable region CDR L2
gatgcatccaacagggcctct

SEQ ID NO: 1855 - protein, 8 aa, Artificial Sequence
  Description of Artificial Sequence: Synthetic light chain variable region CDR L3
QHRSDWWT

SEQ ID NO: 1856 - DNA, 24 bp, Artificial Sequence
  Description of Artificial Sequence: Synthetic light chain variable region CDR L3
cagcatcgtagcgactggtggacg

SEQ ID NO: 1857 - DNA, 366 bp, Artificial Sequence
  Description of Artificial Sequence: Synthetic heavy chain variable region
caggtgcagctacagcagtggggcgcaggactgttgaagccttcggagaccctgtccctcacctgccaagtctatggtgtgtccttcagtgattactactggaactggatccgccagtccccagggaagggactggagtggattggggacgtcaatcatattggaaacaccgactacaacccgtccctcaagagtcgagtctccatatcagtagacacgtccaagaaccagttctccctcaccctgcgctctgtgaccgccgcagacacggctctatactactgtgcgagaggccgtaaactttttgaagtgcctcccaaggcccccgactactggggccagggaaccctggtcaccgtctcctca

SEQ ID NO: 1858 - protein, 122 aa, Artificial Sequence
  Description of Artificial Sequence: Synthetic heavy chain variable region
QVQLQQWGAGLLKPSETLSLTCQVYGVSFSDYYWNWIRQSPGKGLEWIGDVNHIGNTDYNPSLKSRVSISVDTSKNQFSLTLRSVTAADTALYYCARGRKLFEVPPKAPDYWGQGTLVTVSS

SEQ ID NO: 1859 - protein, 9 aa, Artificial Sequence
  Description of Artificial Sequence: Synthetic heavy chain variable region CDR H1
VSFSDYYWN

SEQ ID NO: 1860 - DNA, 27 bp, Artificial Sequence
  Description of Artificial Sequence: Synthetic heavy chain variable region CDR H1
gtgtccttcagtgattactactggaac

SEQ ID NO: 1861 - protein, 16 aa, Artificial Sequence
  Description of Artificial Sequence: Synthetic heavy chain variable region CDR H2
DVNHIGNTDYNPSLKS

SEQ ID NO: 1862 - DNA, 48 bp, Artificial Sequence
  Description of Artificial Sequence: Synthetic heavy chain variable region CDR H2
gacgtcaatcatattggaaacaccgactacaacccgtccctcaagagt

SEQ ID NO: 1863 - protein, 16 aa, Artificial Sequence
  Description of Artificial Sequence: Synthetic heavy chain variable region CDR H3
ARGRKLFEVPPKAPDY

SEQ ID NO: 1864 - DNA, 48 bp, Artificial Sequence
  Description of Artificial Sequence: Synthetic heavy chain variable region CDR H3
gcgagaggccgtaaactttttgaagtgcctcccaaggcccccgactac

SEQ ID NO: 1865 - DNA, 324 bp, Artificial Sequence
  Description of Artificial Sequence: Synthetic light chain variable region
gatattgtgatgacgcagtctccaggcaccctgtctttgtctccaggggaaagagccaccctctcctgcagggccagtcagagtgtgagcagcacctacttagcctggtaccagcagaagcctggccaggctcccaggctcctcatctatggtgcgtccatcagggccactggcatcccagacaggttcagtggcgttgggtctgggacagacttcactctcaccatcagcagactggagcctgaagatgttgcagtgtattactgtcagcagtatgggagctcacctcagacgttcggccaagggaccaaggtggaaatcaaa

SEQ ID NO: 1866 - protein, 108 aa, Artificial Sequence
  Description of Artificial Sequence: Synthetic light chain variable region
DIVMTQSPGTLSLSPGERATLSCRASQSVSSTYLAWYQQKPGQAPRLLIYGASIRATGIPDRFSGVGSGTDFTLTISRLEPEDVAVYYCQQYGSSPQTFGQGTKVEIK

SEQ ID NO: 1867 - protein, 12 aa, Artificial Sequence
  Description of Artificial Sequence: Synthetic light chain variable region CDR L1
RASQSVSSTYLA

SEQ ID NO: 1868 - DNA, 36 bp, Artificial Sequence
  Description of Artificial Sequence: Synthetic light chain variable region CDR L1
agggccagtcagagtgtgagcagcacctacttagcc

SEQ ID NO: 1869 - protein, 7 aa, Artificial Sequence
  Description of Artificial Sequence: Synthetic light chain variable region CDR L2
GASIRAT

SEQ ID NO: 1870 - DNA, 21 bp, Artificial Sequence
  Description of Artificial Sequence: Synthetic light chain variable region CDR L2
ggtgcgtccatcagggccact

SEQ ID NO: 1871 - protein, 9 aa, Artificial Sequence
  Description of Artificial Sequence: Synthetic light chain variable region CDR L3
QQYGSSPQT

SEQ ID NO: 1872 - DNA, 27 bp, Artificial Sequence
  Description of Artificial Sequence: Synthetic light chain variable region CDR L3
cagcagtatgggagctcacctcagacg

SEQ ID NO: 1873 - DNA, 369 bp, Artificial Sequence
  Description of Artificial Sequence: Synthetic heavy chain variable region
caggtgcagctggtggagtctgggggaggcttgattcagcctggggcgtccctgagactctcctgtggagcctatggattcagtttcagcagctctgccatgagctgggtccgccaggctccaggtaaggggctggagtgggtctcagctattagtgataatggtggtagcacatactacgcagactccgtgcagggccggttcaccatctccagagacaattccaagaacacgctgtatctgcaactgaacaggctgagagccgaggacacggccatatattactgtgcgaaagcatattgtagtgatagctgccacgggggctactttgactactggggccagggaaccctggtcaccgtctcctca

SEQ ID NO: 1874 - protein, 123 aa, Artificial Sequence
  Description of Artificial Sequence: Synthetic heavy chain variable region
QVQLVESGGGLIQPGASLRLSCGAYGFSFSSSAMSWVRQAPGKGLEWVSAISDNGGSTYYADSVQGRFTISRDNSKNTLYLQLNRLRAEDTAIYYCAKAYCSDSCHGGYFDYWGQGTLVTVSS

SEQ ID NO: 1875 - protein, 9 aa, Artificial Sequence
  Description of Artificial Sequence: Synthetic heavy chain variable region CDR H1
FSFSSSAMS

SEQ ID NO: 1876 - DNA, 27 bp, Artificial Sequence
  Description of Artificial Sequence: Synthetic heavy chain variable region CDR H1
ttcagtttcagcagctctgccatgagc

SEQ ID NO: 1877 - protein, 17 aa, Artificial Sequence
  Description of Artificial Sequence: Synthetic heavy chain variable region CDR H2
AISDNGGSTYYADSVQG

SEQ ID NO: 1878 - DNA, 51 bp, Artificial Sequence
  Description of Artificial Sequence: Synthetic heavy chain variable region CDR H2
gctattagtgataatggtggtagcacatactacgcagactccgtgcagggc

SEQ ID NO: 1879 - protein, 16 aa, Artificial Sequence
  Description of Artificial Sequence: Synthetic heavy chain variable region CDR H3
AKAYCSDSCHGGYFDY

SEQ ID NO: 1880 - DNA, 48 bp, Artificial Sequence
  Description of Artificial Sequence: Synthetic heavy chain variable region CDR H3
gcgaaagcatattgtagtgatagctgccacgggggctactttgactac

SEQ ID NO: 1881 - DNA, 321 bp, Artificial Sequence
  Description of Artificial Sequence: Synthetic light chain variable region
gaaattgtgttgacgcagtctccagccaccctgtctttgtctccaggggatagagccaccctctcctgcagggccagtcagagtgttagcagctccttcgcctggtaccaacagaaacctggccaggctcccaggctcctcatctatgctgtatccaacagggccactggcatcccagccaggttcagtggcagtgggtctgggacagacttcactctcaccatcagcaccctagagcctgaagactttgcagtttattactgtcagcagcgtagcacctggccgctcactttcggccctgggaccaaggtggagatcaaa

SEQ ID NO: 1882 - protein, 107 aa, Artificial Sequence
  Description of Artificial Sequence: Synthetic light chain variable region
EIVLTQSPATLSLSPGDRATLSCRASQSVSSSFAWYQQKPGQAPRLLIYAVSNRATGIPARFSGSGSGTDFTLTISTLEPEDFAVYYCQQRSTWPLTFGPGTKVEIK

SEQ ID NO: 1883 - protein, 11 aa, Artificial Sequence
  Description of Artificial Sequence: Synthetic light chain variable region CDR L1
RASQSVSSSFA

SEQ ID NO: 1884 - DNA, 33 bp, Artificial Sequence
  Description of Artificial Sequence: Synthetic light chain variable region CDR L1
agggccagtcagagtgttagcagctccttcgcc

SEQ ID NO: 1885 - protein, 7 aa, Artificial Sequence
  Description of Artificial Sequence: Synthetic light chain variable region CDR L2
AVSNRAT

SEQ ID NO: 1886 - DNA, 21 bp, Artificial Sequence
  Description of Artificial Sequence: Synthetic light chain variable region CDR L2
gctgtatccaacagggccact

SEQ ID NO: 1887 - protein, 9 aa, Artificial Sequence
  Description of Artificial Sequence: Synthetic light chain variable region CDR L3
QQRSTWPLT

SEQ ID NO: 1888 - DNA, 27 bp, Artificial Sequence
  Description of Artificial Sequence: Synthetic light chain variable region CDR L3
cagcagcgtagcacctggccgctcact

SEQ ID NO: 1889 - DNA, 384 bp, Artificial Sequence
  Description of Artificial Sequence: Synthetic heavy chain variable region
gaggtgcagctgttggagtcggggggaggcttggtgaagcctggggggtccctaagactctcatgtgcagcctctggattcattttcactaacgcctggatgagctgggtccgccaggctccagggaaggggctggagtgggttggccgtattaaaaggaaaactgaaactgggacaacagactacgctccacccgtgaaaggcagattcaccatctcaagagatgattcaagaagcacgctgtatctgcaaatgaacagcctgaaaaccgaggacacagccgtgtattactgtacgacaggcccaccctatcagtactatgacagtactggttattcggtcgttgactactggggccagggaaccctggtcaccgtctcctca

SEQ ID NO: 1890 - protein, 128 aa, Artificial Sequence
  Description of Artificial Sequence: Synthetic heavy chain variable region
EVQLLESGGGLVKPGGSLRLSCAASGFIFTNAWMSWVRQAPGKGLEWVGRIKRKTETGTTDYAPPVKGRFTISRDDSRSTLYLQMNSLKTEDTAVYYCTTGPPYQYYDSTGYSVVDYWGQGTLVTVSS

SEQ ID NO: 1891 - protein, 9 aa, Artificial Sequence
  Description of Artificial Sequence: Synthetic heavy chain variable region CDR H1
FIFTNAWMS

SEQ ID NO: 1892 - DNA, 27 bp, Artificial Sequence
  Description of Artificial Sequence: Synthetic heavy chain variable region CDR H1
ttcattttcactaacgcctggatgagc

SEQ ID NO: 1893 - protein, 19 aa, Artificial Sequence
  Description of Artificial Sequence: Synthetic heavy chain variable region CDR H2
RIKRKTETGTTDYAPPVKG

SEQ ID NO: 1894 - DNA, 57 bp, Artificial Sequence
  Description of Artificial Sequence: Synthetic heavy chain variable region CDR H2
cgtattaaaaggaaaactgaaactgggacaacagactacgctccacccgtgaaaggc

SEQ ID NO: 1895 - protein, 19 aa, Artificial Sequence
  Description of Artificial Sequence: Synthetic heavy chain variable region CDR H3
TTGPPYQYYDSTGYSVVDY

SEQ ID NO: 1896 - DNA, 57 bp, Artificial Sequence
  Description of Artificial Sequence: Synthetic heavy chain variable region CDR H3
acgacaggcccaccctatcagtactatgacagtactggttattcggtcgttgactac

SEQ ID NO: 1897 - DNA, 342 bp, Artificial Sequence
  Description of Artificial Sequence: Synthetic light chain variable region
tcctatgagctgactcagccaccctcagcgtccgggacccccgggcagagggtcaccatctcttgttctggaagcagctccaacatcggaagtaacatcggaattaattatgtatactggtaccagcagctcccaggaacggcccccaaactcctcatctacagtactaatcagcggccctcaggggtccctgaccgattctctggctcccagtctggcacctcagcctccctggccatcagtgggctccggtccgaggatgaggctgattattactgtgcagcatgggatgacagcctgagtggtccggtgttcggcggagggaccaagctcaccgtccta

SEQ ID NO: 1898 - protein, 114 aa, Artificial Sequence
  Description of Artificial Sequence: Synthetic light chain variable region
SYELTQPPSASGTPGQRVTISCSGSSSNIGSNIGINYVYWYQQLPGTAPKLLIYSTNQRPSGVPDRFSGSQSGTSASLAISGLRSEDEADYYCAAWDDSLSGPVFGGGTKLTVL

SEQ ID NO: 1899 - protein, 17 aa, Artificial Sequence
  Description of Artificial Sequence: Synthetic light chain variable region CDR L1
SGSSSNIGSNIGINYVY

SEQ ID NO: 1900 - DNA, 51 bp, Artificial Sequence
  Description of Artificial Sequence: Synthetic light chain variable region CDR L1
tctggaagcagctccaacatcggaagtaacatcggaattaattatgtatac

SEQ ID NO: 1901 - protein, 7 aa, Artificial Sequence
  Description of Artificial Sequence: Synthetic light chain variable region CDR L2
STNQRPS

SEQ ID NO: 1902 - DNA, 21 bp, Artificial Sequence
  Description of Artificial Sequence: Synthetic light chain variable region CDR L2
agtactaatcagcggccctca

SEQ ID NO: 1903 - protein, 11 aa, Artificial Sequence
  Description of Artificial Sequence: Synthetic light chain variable region CDR L3
AAWDDSLSGPV

SEQ ID NO: 1904 - DNA, 33 bp, Artificial Sequence
  Description of Artificial Sequence: Synthetic light chain variable region CDR L3
gcagcatgggatgacagcctgagtggtccggtg

SEQ ID NO: 1905 - DNA, 360 bp, Artificial Sequence
  Description of Artificial Sequence: Synthetic heavy chain variable region
caggtgcagctggtgcagtctggaccagagttgaaaaagcccggggagtctctgaagatctcctgtaaggcttctggatacagctttacctccttctggatcgcttgggtgcgccagatgcccgggaaaggcctggagtttctggggatcatctatcctggtgacgctgacaccagatacagtccgtccttccaaggccaagtcaccatctcagccgacaagtccatcaacaccgcctacctgcagtggaacaacctgaaggcctcggacaccgccatgtattactgtgcgagacagactacgatgacccccgatgcttttgatctctggggccaagggaccacggtcaccgtctcctca

SEQ ID NO: 1906 - protein, 120 aa, Artificial Sequence
  Description of Artificial Sequence: Synthetic heavy chain variable region
QVQLVQSGPELKKPGESLKISCKASGYSFTSFWIAWVRQMPGKGLEFLGIIYPGDADTRYSPSFQGQVTISADKSINTAYLQWNNLKASDTAMYYCARQTTMTPDAFDLWGQGTTVTVSS

SEQ ID NO: 1907 - protein, 9 aa, Artificial Sequence
  Description of Artificial Sequence: Synthetic heavy chain variable region CDR H1
YSFTSFWIA

SEQ ID NO: 1908 - DNA, 27 bp, Artificial Sequence
  Description of Artificial Sequence: Synthetic heavy chain variable region CDR H1
tacagctttacctccttctggatcgct

SEQ ID NO: 1909 - protein, 17 aa, Artificial Sequence
  Description of Artificial Sequence: Synthetic heavy chain variable region CDR H2
IIYPGDADTRYSPSFQG

SEQ ID NO: 1910 - DNA, 51 bp, Artificial Sequence
  Description of Artificial Sequence: Synthetic heavy chain variable region CDR H2
atcatctatcctggtgacgctgacaccagatacagtccgtccttccaaggc

SEQ ID NO: 1911 - protein, 13 aa, Artificial Sequence
  Description of Artificial Sequence: Synthetic heavy chain variable region CDR H3
ARQTTMTPDAFDL

SEQ ID NO: 1912 - DNA, 39 bp, Artificial Sequence
  Description of Artificial Sequence: Synthetic heavy chain variable region CDR H3
gcgagacagactacgatgacccccgatgcttttgatctc

SEQ ID NO: 1913 - DNA, 324 bp, Artificial Sequence
  Description of Artificial Sequence: Synthetic light chain variable region
gaaattgtgttgacacagtctccagccaccctgtctttgtctccaggggaaagagccactatctcctgcagggccagtcagagtgttagcagctacttagcctggtaccaacagaaacctggccaggctcccaggctcctcatctatgaagcatccgacagggccactggcaccccagccaggttcagtggcagtgggtctgggacagacttcactctcaccatcagcagcctagagcctgaggattttgcagtttattactgtcagcagcgtagtaactggggggtaggaacgttcggccaagggaccaaggtggaaatcaaa

SEQ ID NO: 1914 - protein, 108 aa, Artificial Sequence
  Description of Artificial Sequence: Synthetic light chain variable region
EIVLTQSPATLSLSPGERATISCRASQSVSSYLAWYQQKPGQAPRLLIYEASDRATGTPARFSGSGSGTDFTLTISSLEPEDFAVYYCQQRSNWGVGTFGQGTKVEIK

SEQ ID NO: 1915 - protein, 11 aa, Artificial Sequence
  Description of Artificial Sequence: Synthetic light chain variable region CDR L1
RASQSVSSYLA

SEQ ID NO: 1916 - DNA, 33 bp, Artificial Sequence
  Description of Artificial Sequence: Synthetic light chain variable region CDR L1
agggccagtcagagtgttagcagctacttagcc

SEQ ID NO: 1917 - protein, 7 aa, Artificial Sequence
  Description of Artificial Sequence: Synthetic light chain variable region CDR L2
EASDRAT

SEQ ID NO: 1918 - DNA, 21 bp, Artificial Sequence
  Description of Artificial Sequence: Synthetic light chain variable region CDR L2
gaagcatccgacagggccact

SEQ ID NO: 1919 - protein, 10 aa, Artificial Sequence
  Description of Artificial Sequence: Synthetic light chain variable region CDR L3
QQRSNWGVGT

SEQ ID NO: 1920 - DNA, 30 bp, Artificial Sequence
  Description of Artificial Sequence: Synthetic light chain variable region CDR L3
cagcagcgtagtaactggggggtaggaacg

SEQ ID NO: 1921 - DNA, 387 bp, Artificial Sequence
  Description of Artificial Sequence: Synthetic heavy chain variable region
caggtgcagctggtgcagtctggggctgaggtgaagaagcctgggtcctcggtgagggtcacctgcaaggcttctggaggcaccgtcagcgactatgcaatcacctgggtccgacaggcgcctggacaagggcttgagtggatgggagggttcatccctatgtttggtgtcgcaaaggacgcagagaagttccagggcagagtcacgctgactggggacaaatccacgaacgcagtttacatggagctgagcagcctgacatctgaagacacggccgtctattactgtgcgagatcgaagagactaccagctggtttatctacgtctgactactactactactatttggacgtctggggcaaagggaccacggtcaccgtctcctca

SEQ ID NO: 1922 - protein, 129 aa, Artificial Sequence
  Description of Artificial Sequence: Synthetic heavy chain variable region
QVQLVQSGAEVKKPGSSVRVTCKASGGTVSDYAITWVRQAPGQGLEWMGGFIPMFGVAKDAEKFQGRVTLTGDKSTNAVYMELSSLTSEDTAVYYCARSKRLPAGLSTSDYYYYYLDVWGKGTTVTVSS

SEQ ID NO: 1923 - protein, 9 aa, Artificial Sequence
  Description of Artificial Sequence: Synthetic heavy chain variable region CDR H1
GTVSDYAIT

SEQ ID NO: 1924 - DNA, 27 bp, Artificial Sequence
  Description of Artificial Sequence: Synthetic heavy chain variable region CDR H1
ggcaccgtcagcgactatgcaatcacc

SEQ ID NO: 1925 - protein, 17 aa, Artificial Sequence
  Description of Artificial Sequence: Synthetic heavy chain variable region CDR H2
GFIPMFGVAKDAEKFQG

SEQ ID NO: 1926 - DNA, 51 bp, Artificial Sequence
  Description of Artificial Sequence: Synthetic heavy chain variable region CDR H2
gggttcatccctatgtttggtgtcgcaaaggacgcagagaagttccagggc

SEQ ID NO: 1927 - protein, 22 aa, Artificial Sequence
  Description of Artificial Sequence: Synthetic heavy chain variable region CDR H3
ARSKRLPAGLSTSDYYYYYLDV

SEQ ID NO: 1928 - DNA, 66 bp, Artificial Sequence
  Description of Artificial Sequence: Synthetic heavy chain variable region CDR H3
gcgagatcgaagagactaccagctggtttatctacgtctgactactactactactatttggacgtc

SEQ ID NO: 1929 - DNA, 324 bp, Artificial Sequence
  Description of Artificial Sequence: Synthetic light chain variable region
gaaattgtattgacacagtctccaggcaccctgtctttgtctccaggggaaggagccaccctctcctgtacggccagtcagaatgttttccgcacccacgtagcctggtaccagcagactcctggccaggctcccaggctcctcatctatggtgggtccaccagggccactggcatcccagacaggttcagtggcagcgggtctgggacagacttcactctcatcatcagcagactggaacctgaagattttgcagtctattactgtcatcactttggtaccacaccgtggacgttcggccaagggaccaaggtggagatcaaa

SEQ ID NO: 1930 - protein, 108 aa, Artificial Sequence
  Description of Artificial Sequence: Synthetic light chain variable region
EIVLTQSPGTLSLSPGEGATLSCTASQNVFRTHVAWYQQTPGQAPRLLIYGGSTRATGIPDRFSGSGSGTDFTLIISRLEPEDFAVYYCHHFGTTPWTFGQGTKVEIK

SEQ ID NO: 1931 - protein, 12 aa, Artificial Sequence
  Description of Artificial Sequence: Synthetic light chain variable region CDR L1
TASQNVFRTHVA

SEQ ID NO: 1932 - DNA, 36 bp, Artificial Sequence
  Description of Artificial Sequence: Synthetic light chain variable region CDR L1
acggccagtcagaatgttttccgcacccacgtagcc

SEQ ID NO: 1933 - protein, 7 aa, Artificial Sequence
  Description of Artificial Sequence: Synthetic light chain variable region CDR L2
GGSTRAT

SEQ ID NO: 1934 - DNA, 21 bp, Artificial Sequence
  Description of Artificial Sequence: Synthetic light chain variable region CDR L2
ggtgggtccaccagggccact

SEQ ID NO: 1935 - protein, 9 aa, Artificial Sequence
  Description of Artificial Sequence: Synthetic light chain variable region CDR L3
HHFGTTPWT

SEQ ID NO: 1936 - DNA, 27 bp, Artificial Sequence
  Description of Artificial Sequence: Synthetic light chain variable region CDR L3
catcactttggtaccacaccgtggacg

SEQ ID NO: 1937 - DNA, 369 bp, Artificial Sequence
  Description of Artificial Sequence: Synthetic heavy chain variable region
gaggtgcagctggtggagtctgggcctgaggtgaaggggcctgggtcctcggtgaaagtctcatgcgaggcttctgcagccaccttcagcaactacgctatcagctgggtccgacaggcccctggacaagggcttgagtggatgggagggttcgtccctatgttagggacaaggaactacgcacagaagttcaagggcagagtcactctgaccgcggacgtatccacacatacattgtacttggagattggtagtctgagatttgaggacacggccgtgtattactgtgcgacagtggccggtctgggaaccagctatggtcgataccttgagtcttggggccagggaaccctggtcaccgtctcctca

SEQ ID NO: 1938 - protein, 123 aa, Artificial Sequence
  Description of Artificial Sequence: Synthetic heavy chain variable region
EVQLVESGPEVKGPGSSVKVSCEASAATFSNYAISWVRQAPGQGLEWMGGFVPMLGTRNYAQKFKGRVTLTADVSTHTLYLEIGSLRFEDTAVYYCATVAGLGTSYGRYLESWGQGTLVTVSS

SEQ ID NO: 1939 - protein, 9 aa, Artificial Sequence
  Description of Artificial Sequence: Synthetic heavy chain variable region CDR H1
ATFSNYAIS

SEQ ID NO: 1940 - DNA, 27 bp, Artificial Sequence
  Description of Artificial Sequence: Synthetic heavy chain variable region CDR H1
gccaccttcagcaactacgctatcagc

SEQ ID NO: 1941 - protein, 17 aa, Artificial Sequence
  Description of Artificial Sequence: Synthetic heavy chain variable region CDR H2
GFVPMLGTRNYAQKFKG

SEQ ID NO: 1942 - DNA, 51 bp, Artificial Sequence
  Description of Artificial Sequence: Synthetic heavy chain variable region CDR H2
gggttcgtccctatgttagggacaaggaactacgcacagaagttcaagggc

SEQ ID NO: 1943 - protein, 16 aa, Artificial Sequence
  Description of Artificial Sequence: Synthetic heavy chain variable region CDR H3
ATVAGLGTSYGRYLES

SEQ ID NO: 1944 - DNA, 48 bp, Artificial Sequence
  Description of Artificial Sequence: Synthetic heavy chain variable region CDR H3
gcgacagtggccggtctgggaaccagctatggtcgataccttgagtct

SEQ ID NO: 1945 - DNA, 321 bp, Artificial Sequence
  Description of Artificial Sequence: Synthetic light chain variable region
gacatccggatgacccagtctccatcttctgtgtctgcgtctcttggagacagagtcaccatcacttgtcgggcgagtcaggatattagcaccgcgttagcctggtatcagcagataccagggaaggcccctaaactcctgatctatgaagcatccagtttgcaaagtggggtcccatccaggttcaggggcagtggatctgagacagacttcgctctcactatcagcagcctgcagcctgaagattttgcaacttactattgtcaacaggcaaagagtttcccgtacacttttggccaggggaccaaggtggagatcaaa

SEQ ID NO: 1946 - protein, 107 aa, Artificial Sequence
  Description of Artificial Sequence: Synthetic light chain variable region
DIRMTQSPSSVSASLGDRVTITCRASQDISTALAWYQQIPGKAPKLLIYEASSLQSGVPSRFRGSGSETDFALTISSLQPEDFATYYCQQAKSFPYTFGQGTKVEIK

SEQ ID NO: 1947 - protein, 11 aa, Artificial Sequence
  Description of Artificial Sequence: Synthetic light chain variable region CDR L1
RASQDISTALA

SEQ ID NO: 1948 - DNA, 33 bp, Artificial Sequence
  Description of Artificial Sequence: Synthetic light chain variable region CDR L1
cgggcgagtcaggatattagcaccgcgttagcc

SEQ ID NO: 1949 - protein, 7 aa, Artificial Sequence
  Description of Artificial Sequence: Synthetic light chain variable region CDR L2
EASSLQS

SEQ ID NO: 1950 - DNA, 21 bp, Artificial Sequence
  Description of Artificial Sequence: Synthetic light chain variable region CDR L2
gaagcatccagtttgcaaagt

SEQ ID NO: 1951 - protein, 9 aa, Artificial Sequence
  Description of Artificial Sequence: Synthetic light chain variable region CDR L3
QQAKSFPYT

SEQ ID NO: 1952 - DNA, 27 bp, Artificial Sequence
  Description of Artificial Sequence: Synthetic light chain variable region CDR L3
caacaggcaaagagtttcccgtacact

SEQ ID NO: 1953 - DNA, 375 bp, Artificial Sequence
  Description of Artificial Sequence: Synthetic heavy chain variable region
caggtccagctggtgcagtctgggggaggcttggcgcagcctggagggtccctgagactctcctgtgcagcctccggattcatcttcagtgtttatgaaatggactgggtccgccaggctccagggaaggggctggagtggctttcatacattgatattactggtaatagtgtaacctatgcagactctgtgaggggccggttcaccatctccagagacaacgccaggaactcactctacctgcaaatggacagcctgagagtcgaggacacggctgtatattattgtgttagagatagtcgcggccctacaacgcagtggctcacgggatactttgacttctggggccaggggaccacggtcaccgtctcctca

SEQ ID NO: 1954 - protein, 125 aa, Artificial Sequence
  Description of Artificial Sequence: Synthetic heavy chain variable region
QVQLVQSGGGLAQPGGSLRLSCAASGFIFSVYEMDWVRQAPGKGLEWLSYIDITGNSVTYADSVRGRFTISRDNARNSLYLQMDSLRVEDTAVYYCVRDSRGPTTQWLTGYFDFWGQGTTVTVSS

SEQ ID NO: 1955 - protein, 9 aa, Artificial Sequence
  Description of Artificial Sequence: Synthetic heavy chain variable region CDR H1
FIFSVYEMD

SEQ ID NO: 1956 - DNA, 27 bp, Artificial Sequence
  Description of Artificial Sequence: Synthetic heavy chain variable region CDR H1
ttcatcttcagtgtttatgaaatggac

SEQ ID NO: 1957 - protein, 17 aa, Artificial Sequence
  Description of Artificial Sequence: Synthetic heavy chain variable region CDR H2
YIDITGNSVTYADSVRG

SEQ ID NO: 1958 - DNA, 51 bp, Artificial Sequence
  Description of Artificial Sequence: Synthetic heavy chain variable region CDR H2
tacattgatattactggtaatagtgtaacctatgcagactctgtgaggggc

SEQ ID NO: 1959 - protein, 18 aa, Artificial Sequence
  Description of Artificial Sequence: Synthetic heavy chain variable region CDR H3
VRDSRGPTTQWLTGYFDF

SEQ ID NO: 1960 - DNA, 54 bp, Artificial Sequence
  Description of Artificial Sequence: Synthetic heavy chain variable region CDR H3
gttagagatagtcgcggccctacaacgcagtggctcacgggatactttgacttc

SEQ ID NO: 1961 - DNA, 324 bp, Artificial Sequence
  Description of Artificial Sequence: Synthetic light chain variable region
gacatccggatgacccagtctccagccaccctgtctttgtctccaggggaaagagccaccctctcctgcagggccagtcagagtgttagcaactacttagcctggtaccaacagaaacctggccaggctcccaggctcctcatctatgatgtatccaatagggccactggcatcccagccaggttcagtggcagtgggtccgggacagacttcactctcaccatcagcagcctggagcctgaagattttgcagtttattactgtcagcagcgtcgcaactggcctccgctcactttcggcggagggaccaaggtggaggtcaaa

SEQ ID NO: 1962 - protein, 108 aa, Artificial Sequence
  Description of Artificial Sequence: Synthetic light chain variable region
DIRMTQSPATLSLSPGERATLSCRASQSVSNYLAWYQQKPGQAPRLLIYDVSNRATGIPARFSGSGSGTDFTLTISSLEPEDFAVYYCQQRRNWPPLTFGGGTKVEVK

SEQ ID NO: 1963 - protein, 11 aa, Artificial Sequence
  Description of Artificial Sequence: Synthetic light chain variable region CDR L1
RASQSVSNYLA

SEQ ID NO: 1964 - DNA, 33 bp, Artificial Sequence
  Description of Artificial Sequence: Synthetic light chain variable region CDR L1
agggccagtcagagtgttagcaactacttagcc

SEQ ID NO: 1965 - protein, 7 aa, Artificial Sequence
  Description of Artificial Sequence: Synthetic light chain variable region CDR L2
DVSNRAT

SEQ ID NO: 1966 - DNA, 21 bp, Artificial Sequence
  Description of Artificial Sequence: Synthetic light chain variable region CDR L2
gatgtatccaatagggccact

SEQ ID NO: 1967 - protein, 10 aa, Artificial Sequence
  Description of Artificial Sequence: Synthetic light chain variable region CDR L3
QQRRNWPPLT

SEQ ID NO: 1968 - DNA, 30 bp, Artificial Sequence
  Description of Artificial Sequence: Synthetic light chain variable region CDR L3
cagcagcgtcgcaactggcctccgctcact

SEQ ID NO: 1969 - protein, 14 aa, Artificial Sequence
  CDR H3 Sequence
ARPDINWGQDAFDV

SEQ ID NO: 1970 - protein, 8 aa, Artificial Sequence
  CDR L3 Sequence
QQYKSDPT

SEQ ID NO: 1971 - protein, 21 aa, Artificial Sequence
  CDR H3 Sequence
AIIDPQDCTAASCFWVNWLDP

SEQ ID NO: 1972 - protein, 9 aa, Artificial Sequence
  CDR L3 Sequence
QQYGSAPIT

SEQ ID NO: 1973 - protein, 21 aa, Artificial Sequence
  CDR H3 Sequence
AIIDPQLCTRASCFWVNWLDP

SEQ ID NO: 1974 - protein, 9 aa, Artificial Sequence
  CDR L3 Sequence
QQFGALPIT

SEQ ID NO: 1975 - protein, 14 aa, Artificial Sequence
  CDR H3 Sequence
ATAGWFGESVHLDS

SEQ ID NO: 1976 - protein, 10 aa, Artificial Sequence
  CDR L3 Sequence
QQYNNWPPLT

SEQ ID NO: 1977 - protein, 14 aa, Artificial Sequence
  CDR H3 Sequence
ARDVPADGVHFMDV

SEQ ID NO: 1978 - protein, 9 aa, Artificial Sequence
  CDR L3
MQGSHWAPT

SEQ ID NO: 1979 - protein, 19 aa, Artificial Sequence
  CDR H3 Sequence
ATKRYCSDPSCHGLWYFDL

SEQ ID NO: 1980 - protein, 9 aa, Artificial Sequence
  CDR L3 Sequence
MQRVEFPYT

SEQ ID NO: 1981 - protein, 8 aa, Artificial Sequence
  CDR H3 Sequence
ARIGSNEI

SEQ ID NO: 1982 - protein, 10 aa, Artificial Sequence
  CDR L3 Sequence
CSFTSSGSRV

SEQ ID NO: 1983 - protein, 21 aa, Artificial Sequence
  CDR H3 Sequence
AIIDPQDCTRASCFWVNWLDP

SEQ ID NO: 1984 - protein, 9 aa, Artificial Sequence
  CDR L3 Sequence
QQYDSAPIT

SEQ ID NO: 1985 - protein, 19 aa, Artificial Sequence
  CDR H3 Sequence
ATKRYCTSPSCHGLWYFNL

SEQ ID NO: 1986 - protein, 9 aa, Artificial Sequence
  CDR L3 Sequence
MQRIEYPYT

SEQ ID NO: 1987 - protein, 14 aa, Artificial Sequence
  CDR H3 Sequence
AGSLLAGYDREFDS

SEQ ID NO: 1988 - protein, 9 aa, Artificial Sequence
  CDR L3 Sequence
QQYYIYPLT

SEQ ID NO: 1989 - protein, 15 aa, Artificial Sequence
  CDR H3 Sequence
VRHMNLVMGPFAFDI

SEQ ID NO: 1990 - protein, 10 aa, Artificial Sequence
  CDR L3 Sequence
QSYDRIGMYV

SEQ ID NO: 1991 - protein, 19 aa, Artificial Sequence
  CDR H3 Sequence
STGPPYKYFDETGYSVVDY

SEQ ID NO: 1992 - protein, 11 aa, Artificial Sequence
  CDR L3 Sequence
AAWDDNLSGPV

SEQ ID NO: 1993 - protein, 19 aa, Artificial Sequence
  CDR H3 Sequence
STGPPYSYFDSTGYSVVDY

SEQ ID NO: 1994 - protein, 11 aa, Artificial Sequence
  CDR L3 Sequence
AAWDDSLSGPV

SEQ ID NO: 1995 - protein, 16 aa, Artificial Sequence
  CDR H3 Sequence
ARSQQLLVITDYSLDY

SEQ ID NO: 1996 - protein, 11 aa, Artificial Sequence
  CDR L3 Sequence
NCRDSSGHRLV

SEQ ID NO: 1997 - protein, 19 aa, Artificial Sequence
  CDR H3 Sequence
ATKRYCTSPSCHGLWYFNL

SEQ ID NO: 1998 - protein, 9 aa, Artificial Sequence
  CDR L3 Sequence
MQRVEYPYS

SEQ ID NO: 1999 - protein, 18 aa, Artificial Sequence
  CDR H3 Sequence
AHIGLYDRGGYYLFYFDF

SEQ ID NO: 2000 - protein, 9 aa, Artificial Sequence
  CDR L3 Sequence
QHTYTTPYI

SEQ ID NO: 2001 - protein, 18 aa, Artificial Sequence
  CDR H3 Sequence
VHSDLYDSGGYYLYYFDY

SEQ ID NO: 2002 - protein, 9 aa, Artificial Sequence
  CDR L3 Sequence
QQAYSAPYT

SEQ ID NO: 2003 - protein, 14 aa, Artificial Sequence
  CDR H3 Sequence
ARDVPVIAAGTMDY

SEQ ID NO: 2004 - protein, 9 aa, Artificial Sequence
  CDR L3 Sequence
MQGPHWPRT

SEQ ID NO: 2005 - protein, 17 aa, Artificial Sequence
  CDR H3 Sequence
AKDRAASVHVPAGAFDL

SEQ ID NO: 2006 - protein, 10 aa, Artificial Sequence
  CDR L3 Sequence
QQSFTIPSIT

SEQ ID NO: 2007 - protein, 18 aa, Artificial Sequence
  CDR H3 Sequence
ARTLYYTSGGYYLNLFDY

SEQ ID NO: 2008 - protein, 9 aa, Artificial Sequence
  CDR L3 Sequence
QQSYSSTPT

SEQ ID NO: 2009 - protein, 19 aa, Artificial Sequence
  CDR H3 Sequence
TTGPPYSYFDSTGYSIVDY

SEQ ID NO: 2010 - protein, 11 aa, Artificial Sequence
  CDR L3 Sequence
ASWDDSLSGPV

SEQ ID NO: 2011 - protein, 19 aa, Artificial Sequence
  CDR H3 Sequence
STGPPYKYHDSTGYSVVDY

SEQ ID NO: 2012 - protein, 11 aa, Artificial Sequence
  CDR L3 Sequence
AMWDDSLNGPV

SEQ ID NO: 2013 - protein, 18 aa, Artificial Sequence
  CDR H3 Sequence
TRSETSDYFDSSGYAFHI

SEQ ID NO: 2014 - protein, 9 aa, Artificial Sequence
  CDR L3 Sequence
GSYTDTNRL

SEQ ID NO: 2015 - protein, 10 aa, Artificial Sequence
  CDR H3 Sequence
ARDQWLVPDY

SEQ ID NO: 2016 - protein, 9 aa, Artificial Sequence
  CDR L3 Sequence
SSYAGSNSV

SEQ ID NO: 2017 - protein, 15 aa, Artificial Sequence
  CDR H3 Sequence
ATERMWEENSSSFGW

SEQ ID NO: 2018 - protein, 10 aa, Artificial Sequence
  CDR L3 Sequence
TSYTSRSSYV

SEQ ID NO: 2019 - protein, 14 aa, Artificial Sequence
  CDR H3 Sequence
ARDVPVMGAAFLDY

SEQ ID NO: 2020 - protein, 9 aa, Artificial Sequence
  CDR L3 Sequence
MQGTHWPPT

SEQ ID NO: 2021 - protein, 17 aa, Artificial Sequence
  CDR H3 Sequence
AKDRAASVHVPAGEFDL

SEQ ID NO: 2022 - protein, 10 aa, Artificial Sequence
  CDR L3 Sequence
QQSYTIPSIT

SEQ ID NO: 2023 - protein, 16 aa, Artificial Sequence
  CDR H3 Sequence
ARQRLEHTASGYYMDV

SEQ ID NO: 2024 - protein, 11 aa, Artificial Sequence
  CDR L3 Sequence
QVWDNSSDQPV

SEQ ID NO: 2025 - protein, 12 aa, Artificial Sequence
  CDR H3 Sequence
ARHKENYDFWDF

SEQ ID NO: 2026 - protein, 8 aa, Artificial Sequence
  CDR L3 Sequence
QQYFTSTF

SEQ ID NO: 2027 - protein, 15 aa, Artificial Sequence
  CDR H3 Sequence
VRDVPVISGASTMDY

SEQ ID NO: 2028 - protein, 9 aa, Artificial Sequence
  CDR L3 Sequence
MQATQWPRT

SEQ ID NO: 2029 - protein, 18 aa, Artificial Sequence
  CDR H3 Sequence
VKSDLYDRGGYYLYYFDH

SEQ ID NO: 2030 - protein, 9 aa, Artificial Sequence
  CDR L3 Sequence
QQTFSSPYT

SEQ ID NO: 2031 - protein, 18 aa, Artificial Sequence
  CDR H3 Sequence
VKSDLYDRGGYYLYYFDY

SEQ ID NO: 2032 - protein, 9 aa, Artificial Sequence
  CDR L3 Sequence
QQTFSSPYT

SEQ ID NO: 2033 - protein, 18 aa, Artificial Sequence
  CDR H3 Sequence
VRSSVYASNAYYLYYFDS

SEQ ID NO: 2034 - protein, 9 aa, Artificial Sequence
  CDR L3 Sequence
QQAYSSPYT

SEQ ID NO: 2035 - protein, 19 aa, Artificial Sequence
  CDR H3 Sequence
ATKRYCSDPSCHGLWYFDL

SEQ ID NO: 2036 - protein, 9 aa, Artificial Sequence
  CDR L3 Sequence
MQRAEFPYT

SEQ ID NO: 2037 - protein, 12 aa, Artificial Sequence
  CDR H3 Sequence
ARHKENYDFWDF

SEQ ID NO: 2038 - protein, 8 aa, Artificial Sequence
  CDR L3 Sequence
QQYYSSAF

SEQ ID NO: 2039 - protein, 14 aa, Artificial Sequence
  CDR H3 Sequence
ARDVPVMGAAFLDY

SEQ ID NO: 2040 - protein, 9 aa, Artificial Sequence
  CDR L3 Sequence
MQGTHWPPT

SEQ ID NO: 2041 - protein, 18 aa, Artificial Sequence
  CDR H3 Sequence
VRTPIYASGGYYLSYFDS

SEQ ID NO: 2042 - protein, 9 aa, Artificial Sequence
  CDR L3 Sequence
QQSYSTPYT

SEQ ID NO: 2043 - protein, 18 aa, Artificial Sequence
  CDR H3 Sequence
VHSDRYDRGGYYLYFFDY

SEQ ID NO: 2044 - protein, 9 aa, Artificial Sequence
  CDR L3 Sequence
QQSYTSPYT

SEQ ID NO: 2045 - protein, 18 aa, Artificial Sequence
  CDR H3 Sequence
VHSDLYDRGGYYLFYFDD

SEQ ID NO: 2046 - protein, 9 aa, Artificial Sequence
  CDR L3 Sequence
QQSYTFPYT

SEQ ID NO: 2047 - protein, 16 aa, Artificial Sequence
  CDR H3 Sequence
ARDQRDQAVAGRWFDP

SEQ ID NO: 2048 - protein, 12 aa, Artificial Sequence
  CDR L3 Sequence
QSYDNSLSGSAV

SEQ ID NO: 2049 - protein, 15 aa, Artificial Sequence
  CDR H3 Sequence
ARTMWRWLVEGGFEN

SEQ ID NO: 2050 - protein, 9 aa, Artificial Sequence
  CDR L3 Sequence
MQALQTPLT

SEQ ID NO: 2051 - protein, 14 aa, Artificial Sequence
  CDR H3 Sequence
ATAGWFGELVRFDS

SEQ ID NO: 2052 - protein, 10 aa, Artificial Sequence
  CDR L3 Sequence
QQYNNWPPLT

SEQ ID NO: 2053 - protein, 16 aa, Artificial Sequence
  CDR H3 Sequence
ARASSGTYNFEYWFDP

SEQ ID NO: 2054 - protein, 11 aa, Artificial Sequence
  CDR L3 Sequence
QVWDDPSDHAV

SEQ ID NO: 2055 - protein, 16 aa, Artificial Sequence
  CDR H3 Sequence
ARDWGGHSIFGAVQDL

SEQ ID NO: 2056 - protein, 10 aa, Artificial Sequence
  CDR L3 Sequence
QSYDRSLSQV

SEQ ID NO: 2057 - protein, 18 aa, Artificial Sequence
  CDR H3 Sequence
ARTLYYTSGGYYLNLFDY

SEQ ID NO: 2058 - protein, 9 aa, Artificial Sequence
  CDR L3 Sequence
QQSYSSTPT

SEQ ID NO: 2059 - protein, 19 aa, Artificial Sequence
  CDR H3 Sequence
ARPEGDFGDLKWLRSPFDY

SEQ ID NO: 2060 - protein, 11 aa, Artificial Sequence
  CDR L3 Sequence
QQYDDWPPQLT

SEQ ID NO: 2061 - protein, 22 aa, Artificial Sequence
  CDR H3 Sequence
ARHPSVIYGTFGANGGPNWFDP

SEQ ID NO: 2062 - protein, 10 aa, Artificial Sequence
  CDR L3 Sequence
SSYTGSNTVI

SEQ ID NO: 2063 - protein, 15 aa, Artificial Sequence
  CDR H3 Sequence
ARVTWQWLVLGGFDY

SEQ ID NO: 2064 - protein, 9 aa, Artificial Sequence
  CDR L3 Sequence
MQALHTPLT

SEQ ID NO: 2065 - protein, 16 aa, Artificial Sequence
  CDR H3 Sequence
TLGYCSGDSCSSLRDY

SEQ ID NO: 2066 - protein, 10 aa, Artificial Sequence
  CDR L3 Sequence
SSYTSSSTLV

SEQ ID NO: 2067 - protein, 14 aa, Artificial Sequence
  CDR H3 Sequence
ARDVPADGVHFMDV

SEQ ID NO: 2068 - protein, 9 aa, Artificial Sequence
  CDR L3 Sequence
MQGSHWAPT

SEQ ID NO: 2069 - protein, 15 aa, Artificial Sequence
  CDR H3 Sequence
ARDAIFGSGPNWFDP

SEQ ID NO: 2070 - protein, 11 aa, Artificial Sequence
  CDR L3 Sequence
QSYESSLRGWV

SEQ ID NO: 2071 - protein, 10 aa, Artificial Sequence
  CDR H3 Sequence
ARDQWLVPDY

SEQ ID NO: 2072 - protein, 9 aa, Artificial Sequence
  CDR L3 Sequence
SSYAGSNSV

SEQ ID NO: 2073 - protein, 19 aa, Artificial Sequence
  CDR H3 Sequence
TTGPPYQYFDDSGYSVVDY

SEQ ID NO: 2074 - protein, 11 aa, Artificial Sequence
  CDR L3 Sequence
AAWDDSLGGPV

SEQ ID NO: 2075 - protein, 16 aa, Artificial Sequence
  CDR H3 Sequence
AKASSGSYHFEYWFDP

SEQ ID NO: 2076 - protein, 11 aa, Artificial Sequence
  CDR L3 Sequence
QVWDDADDHAV

SEQ ID NO: 2077 - protein, 10 aa, Artificial Sequence
  CDR H3 Sequence
ARDQWLVPDY

SEQ ID NO: 2078 - protein, 9 aa, Artificial Sequence
  CDR L3 Sequence
SSYAGSNSV

SEQ ID NO: 2079 - protein, 18 aa, Artificial Sequence
  CDR H3 Sequence
VHSDLYDRGGYYLFYFDY

SEQ ID NO: 2080 - protein, 9 aa, Artificial Sequence
  CDR L3 Sequence
QQSYTFPYT

SEQ ID NO: 2081 - protein, 11 aa, Artificial Sequence
  CDR H3 Sequence
GRQELQGSFTI

SEQ ID NO: 2082 - protein, 10 aa, Artificial Sequence
  CDR L3 Sequence
QHYDNLLLFT

SEQ ID NO: 2083 - protein, 18 aa, Artificial Sequence
  CDR H3 Sequence
VHSDLYDSGGYYLYYFDY

SEQ ID NO: 2084 - protein, 9 aa, Artificial Sequence
  CDR L3 Sequence
QQVYTSPYT

SEQ ID NO: 2085 - protein, 18 aa, Artificial Sequence
  CDR H3 Sequence
VHSDLYDRNAYYLHYFDF

SEQ ID NO: 2086 - protein, 9 aa, Artificial Sequence
  CDR L3 Sequence
QQSYSIPYT

SEQ ID NO: 2087 - protein, 18 aa, Artificial Sequence
  CDR H3 Sequence
VHSDLYDSSGYYLYYFDY

SEQ ID NO: 2088 - protein, 9 aa, Artificial Sequence
  CDR L3 Sequence
QQSYTSPYT

SEQ ID NO: 2089 - protein, 19 aa, Artificial Sequence
  CDR H3 Sequence
TTGPPYKYSDSTGYSVVDY

SEQ ID NO: 2090 - protein, 11 aa, Artificial Sequence
  CDR L3 Sequence
AAWDDRLSGPV

SEQ ID NO: 2091 - protein, 14 aa, Artificial Sequence
  CDR H3 Sequence
ATAGWFGELVRFDS

SEQ ID NO: 2092 - protein, 10 aa, Artificial Sequence
  CDR L3 Sequence
QQYNNWPPLT

SEQ ID NO: 2093 - protein, 16 aa, Artificial Sequence
  CDR H3 Sequence
ARVAGLGNSYGRYFDV

SEQ ID NO: 2094 - protein, 9 aa, Artificial Sequence
  CDR L3 Sequence
QQAKSFPYT

SEQ ID NO: 2095 - protein, 18 aa, Artificial Sequence
  CDR H3 Sequence
AREGSDTEYWRLTPPMDV

SEQ ID NO: 2096 - protein, 11 aa, Artificial Sequence
  CDR L3 Sequence
QVWDSGDHPWL

SEQ ID NO: 2097 - protein, 15 aa, Artificial Sequence
  CDR H3 Sequence
ARDLSGSPAYSGSWV

SEQ ID NO: 2098 - protein, 10 aa, Artificial Sequence
  CDR L3 Sequence
QQYDRWPPWT

SEQ ID NO: 2099 - protein, 19 aa, Artificial Sequence
  CDR H3 Sequence
ASEPPGVGFGLIPHYYFDN

SEQ ID NO: 2100 - protein, 9 aa, Artificial Sequence
  CDR L3 Sequence
QQYFSIPPT

SEQ ID NO: 2101 - protein, 19 aa, Artificial Sequence
  CDR H3 Sequence
ARPAGDFGDLKWVRSPFDY

SEQ ID NO: 2102 - protein, 11 aa, Artificial Sequence
  CDR L3 Sequence
QEYNDWPPQLS

SEQ ID NO: 2103 - protein, 18 aa, Artificial Sequence
  CDR H3 Sequence
VHSDVYTTGGYYLYYFDY

SEQ ID NO: 2104 - protein, 9 aa, Artificial Sequence
  CDR L3 Sequence
QQSYSSPYT

SEQ ID NO: 2105 - protein, 15 aa, Artificial Sequence
  CDR H3 Sequence
ARDSGATAAGILWDY

SEQ ID NO: 2106 - protein, 9 aa, Artificial Sequence
  CDR L3 Sequence
MQATHWPRT

SEQ ID NO: 2107 - protein, 14 aa, Artificial Sequence
  CDR H3 Sequence
ARDVPADGVHFMDV

SEQ ID NO: 2108 - protein, 9 aa, Artificial Sequence
  CDR L3 Sequence
MEGSHWAPT

SEQ ID NO: 2109 - protein, 21 aa, Artificial Sequence
  CDR H3 Sequence
AIIDPQDCTSASCFWVNWLDP

SEQ ID NO: 2110 - protein, 9 aa, Artificial Sequence
  CDR L3 Sequence
QQYGTSPIT

SEQ ID NO: 2111 - protein, 19 aa, Artificial Sequence
  CDR H3 Sequence
ARPAGDFGDLKWLRSPFDY

SEQ ID NO: 2112 - protein, 11 aa, Artificial Sequence
  CDR L3 Sequence
QQYNDWPPQLT

SEQ ID NO: 2113 - protein, 19 aa, Artificial Sequence
  CDR H3 Sequence
ARPERDFGHLKWLRSPFDY

SEQ ID NO: 2114 - protein, 11 aa, Artificial Sequence
  CDR L3 Sequence
QQYNDWPPQLT

SEQ ID NO: 2115 - protein, 21 aa, Artificial Sequence
  CDR H3 Sequence
AIIDPQDCTRASCFWVNWLAP

SEQ ID NO: 2116 - protein, 9 aa, Artificial Sequence
  CDR L3 Sequence
QQYGSAPIT

SEQ ID NO: 2117 - protein, 14 aa, Artificial Sequence
  CDR H3 Sequence
ARDVPGDGVHFMDV

SEQ ID NO: 2118 - protein, 9 aa, Artificial Sequence
  CDR L3 Sequence
MEGSHWAPT

SEQ ID NO: 2119 - protein, 11 aa, Artificial Sequence
  CDR H3 Sequence
ARNTIFGVVDY

SEQ ID NO: 2120 - protein, 10 aa, Artificial Sequence [sequence omitted]

SEQ ID NO: 2121 - protein, 15 aa, Artificial Sequence
  CDR H3 Sequence
ARDKGVTVAGSLLDY

SEQ ID NO: 2122 - protein, 10 aa, Artificial Sequence
  CDR L3 Sequence
MESTHWPPYT

SEQ ID NO: 2123 - protein, 15 aa, Artificial Sequence
  CDR H3 Sequence
ARDSPSDTAAALLDF

SEQ ID NO: 2124 - protein, 10 aa, Artificial Sequence
  CDR L3 Sequence
MQATHWPRLS

SEQ ID NO: 2125 - protein, 11 aa, Artificial Sequence
  CDR H3 Sequence
ATVIAVGAYDI

SEQ ID NO: 2126 - protein, 9 aa, Artificial Sequence
  CDR L3 Sequence
QQSYIIPYT

SEQ ID NO: 2127 - protein, 16 aa, Artificial Sequence
  CDR H3 Sequence
ARASSGSYNFEYWFDP

SEQ ID NO: 2128 - protein, 11 aa, Artificial Sequence
  CDR L3 Sequence
QVWDDPSDHAV

SEQ ID NO: 2129 - protein, 15 aa, Artificial Sequence
  CDR H3 Sequence
ARDPPSLTAAGTLDY

SEQ ID NO: 2130 - protein, 9 aa, Artificial Sequence
  CDR L3 Sequence
MQATDWPRT

SEQ ID NO: 2131 - protein, 12 aa, Artificial Sequence
  CDR H3 Sequence
ARDLYSSGWLDN

SEQ ID NO: 2132 - protein, 9 aa, Artificial Sequence
  CDR L3 Sequence
HQYNDWPYT

SEQ ID NO: 2133 - protein, 19 aa, Artificial Sequence
  CDR H3 Sequence
STGPPYSYFDSSGYSVVDY

SEQ ID NO: 2134 - protein, 11 aa, Artificial Sequence
  CDR L3 Sequence
AAWDDSLSGPV

SEQ ID NO: 2135 - protein, 15 aa, Artificial Sequence
  CDR H3 Sequence
VRSLHWGAAIERWDV

SEQ ID NO: 2136 - protein, 9 aa, Artificial Sequence
  CDR L3 Sequence
QQSGSSPYT

SEQ ID NO: 2137 - protein, 10 aa, Artificial Sequence
  CDR H3 Sequence
ARDQWLVPDY

SEQ ID NO: 2138 - protein, 9 aa, Artificial Sequence
  CDR L3 Sequence
SSYAGSNSV

SEQ ID NO: 2139 - protein, 15 aa, Artificial Sequence
  CDR H3 Sequence
ARGRGYSYGWRYFDS

SEQ ID NO: 2140 - protein, 11 aa, Artificial Sequence
  CDR L3 Sequence
QSSDSSGNYVV

SEQ ID NO: 2141 - protein, 21 aa, Artificial Sequence
  CDR H3 Sequence
AIIDPQDCTAASCFWVNWLDP

SEQ ID NO: 2142 - protein, 9 aa, Artificial Sequence
  CDR L3 Sequence
QQYGSSPIT

SEQ ID NO: 2143 - protein, 19 aa, Artificial Sequence
  CDR H3 Sequence
ARPAGDFGDLKWVRSPFDY

SEQ ID NO: 2144 - protein, 11 aa, Artificial Sequence
  CDR L3 Sequence
QEYNDWPPQLT

SEQ ID NO: 2145 - protein, 19 aa, Artificial Sequence
  CDR H3 Sequence
STGPPYSYFDSSGYSVVDY

SEQ ID NO: 2146 - protein, 11 aa, Artificial Sequence
  CDR L3 Sequence
AAWDDSLSGPV

SEQ ID NO: 2147 - protein, 19 aa, Artificial Sequence
  CDR H3 Sequence
ARPEGDFGDLKWVRSPFDY

SEQ ID NO: 2148 - protein, 11 aa, Artificial Sequence
  CDR L3 Sequence
QEYNDWPPQLT

SEQ ID NO: 2149 - protein, 21 aa, Artificial Sequence
  CDR H3 Sequence
AIIDPQDCTRASCFWVNWLAP

SEQ ID NO: 2150 - protein, 9 aa, Artificial Sequence
  CDR L3 Sequence
QQYETSPIT

SEQ ID NO: 2151 - protein, 19 aa, Artificial Sequence
  CDR H3 Sequence
STGPPYSYFDSSGYSVVDY

SEQ ID NO: 2152 - protein, 11 aa, Artificial Sequence
  CDR L3 Sequence
AAWDDSLSGPV

SEQ ID NO: 2153 - protein, 22 aa, Artificial Sequence
  CDR H3 Sequence
ARDLQTGIMSSVRSEYRGFMDP

SEQ ID NO: 2154 - protein, 11 aa, Artificial Sequence
  CDR L3 Sequence
AAWDDSLNGWV

SEQ ID NO: 2155 - protein, 15 aa, Artificial Sequence
  CDR H3 Sequence
AKSSRLLDWLYNMDF

SEQ ID NO: 2156 - protein, 11 aa, Artificial Sequence
  CDR L3 Sequence
QVWDNSNSQGV

SEQ ID NO: 2157 - protein, 15 aa, Artificial Sequence
  CDR H3 Sequence
ARGRGYTYGWRYFDY

SEQ ID NO: 2158 - protein, 11 aa, Artificial Sequence
  CDR L3 Sequence
QSSDSSGNVVL

SEQ ID NO: 2159 - protein, 17 aa, Artificial Sequence
  CDR H3 Sequence
ARDSGTLTGLPHDAFDI

SEQ ID NO: 2160 - protein, 9 aa, Artificial Sequence
  CDR L3 Sequence
QQYSSYSWT

SEQ ID NO: 2161 - protein, 19 aa, Artificial Sequence
  CDR H3 Sequence
STGPPYSYFDSSGYSVVDY

SEQ ID NO: 2162 - protein, 11 aa, Artificial Sequence
  CDR L3 Sequence
AAWDDSLSGPV

SEQ ID NO: 2163 - protein, 15 aa, Artificial Sequence
  CDR H3 Sequence
AKSSRFLDWLYNMDF

SEQ ID NO: 2164 - protein, 11 aa, Artificial Sequence
  CDR L3 Sequence
QVWDNSHSQGV

SEQ ID NO: 2165 - protein, 17 aa, Artificial Sequence
  CDR H3 Sequence
ARDSGTLTGLPHDAFDV

SEQ ID NO: 2166 - protein, 9 aa, Artificial Sequence
  CDR L3 Sequence
HHYNSYSWT

SEQ ID NO: 2167 - protein, 17 aa, Artificial Sequence
  CDR H3 Sequence
ARDGDLVAVPAAIGFDS

SEQ ID NO: 2168 - protein, 9 aa, Artificial Sequence
  CDR L3 Sequence
QQYSSPPYT

SEQ ID NO: 2169 - protein, 16 aa, Artificial Sequence
  CDR H3 Sequence
ARVIGDGTILGVVFDY

SEQ ID NO: 2170 - protein, 10 aa, Artificial Sequence
  CDR L3 Sequence
QSYDSSLSVI

SEQ ID NO: 2171 - protein, 17 aa, Artificial Sequence
  CDR H3 Sequence
TIILIPAPIRAPDGFDI

SEQ ID NO: 2172 - protein, 10 aa, Artificial Sequence
  CDR L3 Sequence
QSYDSSYHVV

SEQ ID NO: 2173 - protein, 16 aa, Artificial Sequence
  CDR H3 Sequence
ARVAGLGNSYGRYPDL

SEQ ID NO: 2174 - protein, 9 aa, Artificial Sequence
  CDR L3 Sequence
QQANSFPYT

SEQ ID NO: 2175 - protein, 14 aa, Artificial Sequence
  CDR H3 Sequence
ARMLASVGLSNFDA

SEQ ID NO: 2176 - protein, 11 aa, Artificial Sequence
  CDR L3 Sequence
QVWDSISDHVL

SEQ ID NO: 2177 - protein, 21 aa, Artificial Sequence
  CDR H3 Sequence
TSHAYNSDWFVTTDYYYYMDV

SEQ ID NO: 2178 - protein, 9 aa, Artificial Sequence
  CDR L3 Sequence
QQCYSAPIT

SEQ ID NO: 2179 - protein, 23 aa, Artificial Sequence
  CDR H3 Sequence
ARGISPRTNSDWNHNYFYYYMDV

SEQ ID NO: 2180 - protein, 9 aa, Artificial Sequence
  CDR L3 Sequence
HHYGTSPHT

SEQ ID NO: 2181 - protein, 12 aa, Artificial Sequence
  CDR H3 Sequence
ARVLTTWHGPDY

SEQ ID NO: 2182 - protein, 9 aa, Artificial Sequence
  CDR L3 Sequence
MQGSHWPHT

SEQ ID NO: 2183 - protein, 15 aa, Artificial Sequence
  CDR H3 Sequence
ARDVWGWELVGWLDP

SEQ ID NO: 2184 - protein, 11 aa, Artificial Sequence
  CDR L3 Sequence
QVWDSSRDHVV

SEQ ID NO: 2185 - protein, 18 aa, Artificial Sequence
  CDR H3 Sequence
ARTPIYDSSGYYLYYFDS

SEQ ID NO: 2186 - protein, 9 aa, Artificial Sequence
  CDR L3 Sequence
QQSYSTPVT

SEQ ID NO: 2187 - protein, 17 aa, Artificial Sequence
  CDR H3 Sequence
ARDGDIVAVPAAIGLDY

SEQ ID NO: 2188 - protein, 9 aa, Artificial Sequence
  CDR L3 Sequence
QQYSSPPYT

SEQ ID NO: 2189 - protein, 15 aa, Artificial Sequence
  CDR H3 Sequence
ARGRGYSYGWRFFDN

SEQ ID NO: 2190 - protein, 11 aa, Artificial Sequence
  CDR L3 Sequence
QSGDTSGSYVV

SEQ ID NO: 2191 - protein, 23 aa, Artificial Sequence
  CDR H3 Sequence
ARSRKNVIGDTSAWEHMYFYMDV

SEQ ID NO: 2192 - protein, 8 aa, Artificial Sequence
  CDR L3 Sequence
QQYGRSMT

SEQ ID NO: 2193 - protein, 24 aa, Artificial Sequence
  CDR H3 Sequence
ARSNPVARDFWSGYSDDSSYAMDV

SEQ ID NO: 2194 - protein, 9 aa, Artificial Sequence
  CDR L3 Sequence
QQYGASAFS

SEQ ID NO: 2195 - protein, 19 aa, Artificial Sequence
  CDR H3 Sequence
TTGPPYKYFDSTGYSVVDY

SEQ ID NO: 2196 - protein, 11 aa, Artificial Sequence
  CDR L3 Sequence
AAWDDRMSGPV

SEQ ID NO: 2197 - protein, 17 aa, Artificial Sequence
  CDR H3 Sequence
AKAYCSNKACHGGYFDY

SEQ ID NO: 2198 - protein, 9 aa, Artificial Sequence
  CDR L3 Sequence
HQRSDWPLT

SEQ ID NO: 2199 - protein, 13 aa, Artificial Sequence
  CDR H3 Sequence
ARESGLPRGAFQI

SEQ ID NO: 2200 - protein, 8 aa, Artificial Sequence
  CDR L3 Sequence
QHRSDWWT

SEQ ID NO: 2201 - protein, 16 aa, Artificial Sequence
  CDR H3 Sequence
ARGRKLFEVPPKAPDY

SEQ ID NO: 2202 - protein, 9 aa, Artificial Sequence
  CDR L3 Sequence
QQYGSSPQT

SEQ ID NO: 2203 - protein, 16 aa, Artificial Sequence
  CDR H3 Sequence
AKAYCSDSCHGGYFDY

SEQ ID NO: 2204 - protein, 9 aa, Artificial Sequence
  CDR L3 Sequence
QQRSTWPLT

SEQ ID NO: 2205 - protein, 19 aa, Artificial Sequence
  CDR H3 Sequence
TTGPPYQYYDSTGYSVVDY

SEQ ID NO: 2206 - protein, 11 aa, Artificial Sequence
  CDR L3 Sequence
AAWDDSLSGPV

SEQ ID NO: 2207 - protein, 13 aa, Artificial Sequence
  CDR H3 Sequence
ARQTTMTPDAFDL

SEQ ID NO: 2208 - protein, 10 aa, Artificial Sequence
  CDR L3 Sequence
QQRSNWGVGT

SEQ ID NO: 2209 - protein, 22 aa, Artificial Sequence
  CDR H3 Sequence
ARSKRLPAGLSTSDYYYYYLDV

SEQ ID NO: 2210 - protein, 9 aa, Artificial Sequence
  CDR L3 Sequence
HHFGTTPWT

SEQ ID NO: 2211 - protein, 16 aa, Artificial Sequence
  CDR H3 Sequence
ATVAGLGTSYGRYLES

SEQ ID NO: 2212 - protein, 9 aa, Artificial Sequence
  CDR L3 Sequence
QQAKSFPYT

SEQ ID NO: 2213 - protein, 18 aa, Artificial Sequence
  CDR H3 Sequence
VRDSRGPTTQWLTGYFDF

SEQ ID NO: 2214 - protein, 10 aa, Artificial Sequence
  CDR L3 Sequence
QQRRNWPPLT

SEQ ID NO: 2215 - protein, 10 aa, Artificial Sequence
  consensus motif
  misc_feature (2)..(2): Xaa is E or Q
  misc_feature (3)..(3): Xaa is G or S
  misc_feature (4)..(4): Xaa is T or S
  misc_feature (7)..(7): Xaa is P or A
  misc_feature (9)..(9): Xaa is Y or no amino acid
MXXXHWXPXT

SEQ ID NO: 2216 - protein, 10 aa, Artificial Sequence
  consensus motif
  misc_feature (9)..(9): Xaa is L or W
QQYNNWPPXT

SEQ ID NO: 2217 - protein, 10 aa, Artificial Sequence
  consensus motif
  misc_feature (3)..(3): Xaa is A or G
  misc_feature (4)..(4): Xaa is T or P
  misc_feature (5)..(5): Xaa is Q or H
  misc_feature (9)..(9): Xaa is T or L
  misc_feature (10)..(10): Xaa is S or no amino acid
MQXXXWPRXX

SEQ ID NO: 2218 - protein, 9 aa, Artificial Sequence
  consensus motif
SSYAGSNSV

SEQ ID NO: 2219 - protein, 11 aa, Artificial Sequence
  consensus motif
  misc_feature (3)..(3): Xaa is Y or G
  misc_feature (5)..(5): Xaa is R or T
  misc_feature (6)..(6): Xaa is I or S
  misc_feature (8)..(8): Xaa is M or S
  misc_feature (11)..(11): Xaa is V or no amino acid
QSXDXXGXYVX

SEQ ID NO: 2220 - protein, 11 aa, Artificial Sequence
  consensus motif
  misc_feature (5)..(5): Xaa is S or D
  misc_feature (6)..(6): Xaa is S or P
  misc_feature (7)..(7): Xaa is R or S
  misc_feature (10)..(10): Xaa is V or A
QVWDXXXDHXV

SEQ ID NO: 2221 - protein, 9 aa, Artificial Sequence
  consensus motif
  misc_feature (3)..(3): Xaa is Y or C
  misc_feature (4)..(4): Xaa is F or Y
  misc_feature (6)..(6): Xaa is I or A
  misc_feature (8)..(8): Xaa is P or I
QQXXSXPXT

SEQ ID NO: 2222 - protein, 9 aa, Artificial Sequence
  CDR L3 Sequence
MQGSHWAPT

SEQ ID NO: 2223 - protein, 9 aa, Artificial Sequence
  CDR L3 Sequence
MQGTHWPPT

SEQ ID NO: 2224 - protein, 9 aa, Artificial Sequence
  CDR L3 Sequence
MQGPHWPRT

SEQ ID NO: 2225 - protein, 10 aa, Artificial Sequence
  CDR L3 Sequence
MESTHWPPYT

SEQ ID NO: 2226 - protein, 10 aa, Artificial Sequence
  CDR L3 Sequence
MQATHWPRLS

SEQ ID NO: 2227 - protein, 11 aa, Artificial Sequence
  CDR L3 Sequence
QSGDTSGSYVV

SEQ ID NO: 2228 - protein, 11 aa, Artificial Sequence
  CDR L3 Sequence
QVWDDPSDHAV

SEQ ID NO: 2229 - protein, 11 aa, Artificial Sequence
  CDR L3 Sequence
QVWDSSRDHVV

SEQ ID NO: 2230 - protein, 9 aa, Artificial Sequence
  CDR L3 Sequence
QQCYSAPIT

SEQ ID NO: 2231 - protein, 9 aa, Artificial Sequence
  CDR L3 Sequence
MEGSHWAPT

SEQ ID NO: 2232 - protein, 10 aa, Artificial Sequence [sequence omitted]

SEQ ID NO: 2233 - protein, 9 aa, Artificial Sequence
  CDR L3 Sequence
MQATQWPRT

SEQ ID NO: 2234 - protein, 9 aa, Artificial Sequence
  CDR L3 Sequence
QQYFSIPPT

SEQ ID NO: 2235 - protein, 9 aa, Artificial Sequence
  CDR L3 Sequence
SSYAGSNSV

SEQ ID NO: 2236 - protein, 10 aa, Artificial Sequence
  CDR L3 Sequence
QSYDRIGMYV

SEQ ID NO: 2237 - protein, 10 aa, Artificial Sequence
  CDR L3 Sequence
QQYNNWPPLT

SEQ ID NO: 2238 - protein, 15 aa, Artificial Sequence
  consensus motif
  misc_feature (4)..(4): Xaa is V, K, S, or Q
  misc_feature (5)..(5): Xaa is P, G, or W
  misc_feature (6)..(6): Xaa is A, V, S, G, or no amino acid
  misc_feature (7)..(7): Xaa is D, M, I, T, W, or no amino acid
  misc_feature (8)..(8): Xaa is G, A, V, T, E, or no amino acid
  misc_feature (9)..(9): Xaa is V, A, or L
  misc_feature (10)..(10): Xaa is H, A, G, or V
  misc_feature (11)..(11): Xaa is F, T, S, A, G, or P
  misc_feature (12)..(12): Xaa is M, L, or W
  misc_feature (13)..(13): Xaa is L or no amino acid
  misc_feature (15)..(15): Xaa is V, Y, F, or P
ARDXXXXXXXXXXDX

SEQ ID NO: 2239 - protein, 14 aa, Artificial Sequence
  consensus motif
  misc_feature (9)..(9): Xaa is S or L
  misc_feature (11)..(11): Xaa is H or R
  misc_feature (12)..(12): Xaa is L or F
ATAGWFGEXVXXDS

SEQ ID NO: 2240 - protein, 14 aa, Artificial Sequence
  consensus motif
  misc_feature (6)..(6): Xaa is S or T
  misc_feature (11)..(11): Xaa is F or Y
  misc_feature (14)..(14): Xaa is N, S, or Y
ARGRYXYGWRXFDX

SEQ ID NO: 2241 - protein, 16 aa, Artificial Sequence
  consensus motif
  misc_feature (7)..(7): Xaa is T or S
ARASSGXYNFEYWFDP

SEQ ID NO: 2242 - protein, 18 aa, Artificial Sequence
  consensus motif
  misc_feature (3)..(3): Xaa is D, H, S, or T
  misc_feature (4)..(4): Xaa is V, M, S, P, or L
  misc_feature (5)..(5): Xaa is P, N, V, I, H, or R
  misc_feature (6)..(6): Xaa is V, L, Y, W, or G
  misc_feature (7)..(7): Xaa is I, V, A, G, or P
  misc_feature (8)..(8): Xaa is S, M, A, or T
  misc_feature (9)..(9): Xaa is G, N, A, or T
  misc_feature (10)..(10): Xaa is A, P, G, I, or Q
  misc_feature (11)..(11): Xaa is S, F, Y, E, or W
  misc_feature (12)..(12): Xaa is T, A, Y, R, or L
  misc_feature (13)..(13): Xaa is M, F, L, W, or T
  misc_feature (14)..(14): Xaa is D, Y, S, or G
  misc_feature (15)..(15): Xaa is Y, I, or V
  misc_feature (16)..(16): Xaa is F or no amino acid
  misc_feature (17)..(17): Xaa is D or no amino acid
  misc_feature (18)..(18): Xaa is S, F, or no amino acid
VRXXXXXXXXXXXXXXXX

SEQ ID NO: 2243 - protein, 14 aa, Artificial Sequence
  CDR H3 Sequence
ARDVPADGVHFMDV

SEQ ID NO: 2244 - protein, 14 aa, Artificial Sequence
  CDR H3 Sequence
ARDVPVMGAAFLDY

SEQ ID NO: 2245 - protein, 14 aa, Artificial Sequence
  CDR H3 Sequence
ARDVPVIAAGTMDY

SEQ ID NO: 2246 - protein, 15 aa, Artificial Sequence
  CDR H3 Sequence
ARDKGVTVAGSLLDY

SEQ ID NO: 2247 - protein, 15 aa, Artificial Sequence
  CDR H3 Sequence
ARDSPSDTAAALLDF

SEQ ID NO: 2248 - protein, 15 aa, Artificial Sequence
  CDR H3 Sequence
ARGRGYSYGWRFFDN

SEQ ID NO: 2249 - protein, 16 aa, Artificial Sequence
  CDR H3 Sequence
ARASSGTYNFEYWFDP

SEQ ID NO: 2250 - protein, 15 aa, Artificial Sequence
  CDR H3 Sequence
ARDVWGWELVGWLDP

SEQ ID NO: 2251 - protein, 21 aa, Artificial Sequence
  CDR H3 Sequence
TSHAYNSDWFVTTDYYYYMDV

SEQ ID NO: 2252 - protein, 14 aa, Artificial Sequence
  CDR H3 Sequence
ARDVPGDGVHFMDV

SEQ ID NO: 2253 - protein, 11 aa, Artificial Sequence
  CDR H3 Sequence
ARNTIFGVVDY

SEQ ID NO: 2254 - protein, 15 aa, Artificial Sequence
  CDR H3 Sequence
VRDVPVISGASTMDY

SEQ ID NO: 2255 - protein, 19 aa, Artificial Sequence
  CDR H3 Sequence
ASEPPGVGFGLIPHYYFDN

SEQ ID NO: 2256 - protein, 10 aa, Artificial Sequence
  CDR H3 Sequence
ARDQWLVPDY

SEQ ID NO: 2257 - protein, 15 aa, Artificial Sequence
  CDR H3 Sequence
VRHMNLVMGPFAFDI

SEQ ID NO: 2258 - protein, 14 aa, Artificial Sequence
  CDR H3 Sequence
ATAGWFGESVHLDS

SEQ ID NO: 2259 - protein, 14 aa, Artificial Sequence
  CDR H3 Sequence
ATAGWFGELVRFDS

What is claimed is:

1. An isolated antibody or antigen-binding fragment thereof that binds to Respiratory Syncytial Virus (RSV) F protein (F), which comprises a heavy chain variable region (VH) comprising a CDRH1, a CDRH2, and a CDRH3; and a light chain variable region (VL) comprising a CDRL1, a CDRL2, and a CDRL3, wherein the CDRH1, CDRH2, CDRH3, CDRL1, CDRL2, and CDRL3 comprise the amino acid sequences of SEQ ID NOS: 163, 165, 167, 171, 173 and 175 respectively.

2. The antibody or antibody fragment according to claim 1, wherein:
the VH comprises an amino acid sequence that possesses at least 90% sequence identity to SEQ ID NO: 162; and/or
the VL comprises an amino acid sequence that possesses at least 90% sequence identity to SEQ ID NO: 170.

3. The antibody or antibody fragment according to claim 1, wherein:
the VH comprises an amino acid sequence that possesses at least 95% sequence identity to SEQ ID NO: 162; and/or
the VL comprises an amino acid sequence that possesses at least 95% sequence identity to SEQ ID NO: 170.

4. The antibody or antibody fragment according to claim 1, wherein:
the VH comprises the amino acid sequence of SEQ ID NO: 162; and/or the VL comprises the amino acid sequence of SEQ ID NO: 170.

5. The antibody or antibody fragment according to claim 1, wherein:

the VH consists of the amino acid sequence of SEQ ID NO: 162; and (B) the VL consists of the amino acid sequence of SEQ ID NO: 170.

6. A pharmaceutical composition comprising: (i) the antibody or antibody fragment according claim 1; and (ii) a pharmaceutically acceptable carrier and/or excipient.

7. A pharmaceutical composition comprising: (i) antibody or antibody fragment according claim 2; and (ii) a pharmaceutically acceptable carrier and/or excipient.

8. A pharmaceutical composition comprising: (i) the antibody or antibody fragment according claim 3; and (ii) a pharmaceutically acceptable carrier and/or excipient.

9. A pharmaceutical composition comprising: (i) the antibody or antibody fragment according claim 4; and (ii) a pharmaceutically acceptable carrier and/or excipient.

10. A pharmaceutical composition comprising: (i) the antibody or antibody fragment according claim 5; and (ii) a pharmaceutically acceptable carrier and/or excipient.

11. An isolated or recombinant nucleic acid encoding an antibody or antibody fragment according to claim 1 or a vector comprising said nucleic acid.

12. An isolated or recombinant nucleic acid encoding an antibody or antibody fragment according to claim 2 or a vector comprising said nucleic acid.

13. An isolated or recombinant nucleic acid encoding an antibody or antibody fragment according to claim 3 or a vector comprising said nucleic acid.

14. An isolated or recombinant nucleic acid encoding an antibody or antibody fragment according to claim 4 or a vector comprising said nucleic acid.

15. An isolated or recombinant nucleic acid encoding an antibody or antibody fragment according to claim 5 or a vector comprising said nucleic acid.

16. A host cell transfected, transformed, or transduced with the isolated or recombinant nucleic acid according to claim 11 or an expression vector containing said nucleic acid.

17. A host cell transfected, transformed, or transduced with the isolated or recombinant nucleic acid according to claim 12 or an expression vector containing said nucleic acid.

18. A host cell transfected, transformed, or transduced with the isolated or recombinant nucleic acid according to claim 13 or an expression vector containing said nucleic acid.

19. A host cell transfected, transformed, or transduced with the isolated or recombinant nucleic acid according to claim 14 or an expression vector containing said nucleic acid.

20. A host cell transfected, transformed, or transduced with the isolated or recombinant nucleic acid according to claim 15 or an expression vector containing said nucleic acid.

21. A method of treating or preventing RSV infection and/or HMPV infection, or at least one symptom associated with RSV infection and/or HMPV infection, comprising administering to a patient in need thereof or suspected of being in need thereof one or more antibodies or antigen-binding fragments thereof that bind to Respiratory Syncytial Virus (RSV) F protein (F), and which neutralize hMPV, wherein said one or more antibodies or antigen-binding fragments thereof (i) comprise a heavy chain variable region (VH) comprising a CDRH1, a CDRH2, and a CDRH3; and (ii) a light chain variable region (VL) comprising a CDRL1, a CDRL2, and a CDRL3, wherein the CDRH1, CDRH2, CDRH3, CDRL1, CDRL2, and CDRL3 comprise the amino acid sequences of SEQ ID NOS: 163, 165, 167, 171, 173 and 175 respectively, such that the RSV infection and/or the HMPV infection is treated or prevented, or the at least one symptom associated with RSV infection is treated, alleviated, or reduced in severity.

22. The method of claim 21, wherein the one or more antibodies or antigen-binding fragments thereof (i) comprise a VH region comprising the amino acid sequence of SEQ ID NO: 162; and (ii) a VL region comprising the amino acid sequence of SEQ ID NO: 170.

* * * * *